United States Patent 11,827,710 (ANTIBODIES THAT BIND TO C-TYPE LECTIN DOMAIN FAMILY 2 MEMBER D (CLEC2D)) - sequence listing, part 2

SEQ ID NO: 1966 - protein, 450 aa, Artificial Sequence
  chemically synthesized
QVQLVQSGGGVVQPGRSLRLSCAASGFTFSSSAMHWVRQAPGKGLEWVAMIWHDESKKYYADSVKGRFTISRDNSKNTLYLQMNSLRAEDTAVYYCARPPDGGNSGRWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1967 - protein, 456 aa, Artificial Sequence
  chemically synthesized
QMQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDKNVRKHDYGDHPYGGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1968 - protein, 445 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVAGATSLWYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1969 - protein, 448 aa, Artificial Sequence
  chemically synthesized
QVQLQQSGPGLVKPSQSLSLTCAISGDSVSSNSAAWNWIRQSPSRGLEWLGRTYYRSKWYNDYAVSVKSRITIKPDTSKNQFSLQLNSVTPEDTAVYYCTRLANSDGVDVWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1970 - protein, 447 aa, Artificial Sequence
  chemically synthesized
QVQLQQSGPGLVKPSQTLSLTCAISGDSVSSDSAVWTWIRQSPSRGLEWLGRTYYKSKWYNDYAASVKSRITINPDTSKNQFSLHLNSVTPEDTAVYYCARGVTRTFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1971 - protein, 446 aa, Artificial Sequence
  chemically synthesized
QLQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAEGNGPFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1972 - protein, 447 aa, Artificial Sequence
  chemically synthesized
QITLKESGGGVVQPGRSLRLSCVASGFTFSTYPMHWVRQAPGKGLEWVAVISYDGRNEYYADSVKGRFTISRDNSKNTLYLQMNSLRAEDTAVYYCATRDTPLVGVSIYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1973 - protein, 448 aa, Artificial Sequence
  chemically synthesized
QMQLVQSGGGLVKAGGSLRLSCSASGFTFSSYAMHWVRQAPGKGLEYVSAISSNGGSTYYADSVKGRFTISRDNSKNTLYLQMSSLRAEDTAVYYCVNRAGYGDYRHFQHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1974 - protein, 446 aa, Artificial Sequence
  chemically synthesized
EVQLVQSGGGVVQPGGSLRLSCAASGFTFSSYGMHWVRQAPGKGLEWVAFISYDGSNKYYADSVKGRFTISRDNSKNTLYLQMNSLRAEDTAVYYCATTGDRFQEFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1975 - protein, 449 aa, Artificial Sequence
  chemically synthesized
QMQLVQSGGVLLQPGRSLRLSCTASGFTFAAYNINWFRQGPGGGLEWVGFIRANADSGTTEYAASVKGRFFISRDDSRSTAYLQMTSLKTEDTAVYYCARDDRGRGDDFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1976 - protein, 448 aa, Artificial Sequence
  chemically synthesized
QVQLVQSGGGLVQPGGSLRLSCAASGFTFSSYGMTWVRQAPGKGLEWVSTISGNGVGTYYPDSVKDRFTISRDSSKNTVYLQMNSLRAEDTAVYYCVKHGRAGINWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1977 - protein, 448 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGGLWAFDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1978 - protein, 444 aa, Artificial Sequence
  chemically synthesized
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKIGSCPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1979 - protein, 448 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPDSSSQCFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1980 - protein, 446 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1981 - protein, 449 aa, Artificial Sequence
  chemically synthesized
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDVNPELLGAGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1982 - protein, 450 aa, Artificial Sequence
  chemically synthesized
QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1983 - protein, 450 aa, Artificial Sequence
  chemically synthesized
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVKAPRGVVPAAMRGGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1984 - protein, 451 aa, Artificial Sequence
  chemically synthesized
QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1985 - protein, 456 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRSLPYRGLAPRSFGGYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1986 - protein, 448 aa, Artificial Sequence
  chemically synthesized
QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1987 - protein, 451 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGMYYYGSGSSYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1988 - protein, 448 aa, Artificial Sequence
  chemically synthesized
QVQLVQSGGGLVQPGGSLRLSCAASGFTFSSYAMSWVRQAPGKGLEWVSGISGSGGSTYYADSVKGRFTISRDNSKNMLFLQMNSPRAEDTAVYYCAKKIAAAGKQPVDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1989 - protein, 458 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRKVYDYVWGSYRLPGSVSYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1990 - protein, 446 aa, Artificial Sequence
  chemically synthesized
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPGRAARPDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1991 - protein, 452 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGAVAGTKPKYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1992 - protein, 450 aa, Artificial Sequence
  chemically synthesized
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARATYYYDSSGYRFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1993 - protein, 443 aa, Artificial Sequence
  chemically synthesized
EVQLVQSGGGLVEPGGSLRLSCAASRFTFSDAWMSWVRQAPGKGLEWVGRIKSKISGGTTDYAAPVQGRFTISRDDSKNTLYLQMDSLKTEDTAVYYCANRNLGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1994 - protein, 454 aa, Artificial Sequence
  chemically synthesized
EVQLVQSGAEVKKPGASVKVSCKASGYTFTSYAMHWVRQAPGQRLEWMGWINAGNGNTKYSQKFQGRVTMTTDTSTSTAYMELRSLRSDDTAVYYCARARYYDSSGYIAPSGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1995 - protein, 449 aa, Artificial Sequence
  chemically synthesized
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGPAVDGAEYFQHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1996 - protein, 450 aa, Artificial Sequence
  chemically synthesized
QLQLQESGPGLVKPSQTLSLTCAISGDSVSSNSAAWNWIRQSPSRGLEWLGRTYYRSKWYNDYAVSLKSRITINPDTSKNQFSLQLNSVTPEDTAVYYCASLASGSPPPGDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1997 - protein, 446 aa, Artificial Sequence
  chemically synthesized
QVTLKESGGGVVQPGRSLRLSCAASGFTFSTYGMHWVRQAPGKGLEWVALISYDGSKKYYANSVKGRFTISRDNSKNTLYLQMKSLRAEDTAMYYCAKGPIVGATMDYWGQGALVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1998 - protein, 445 aa, Artificial Sequence
  chemically synthesized
EVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARWYGDYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1999 - protein, 455 aa, Artificial Sequence
  chemically synthesized
EVQLVQSGAEVKKPGASVKVSCKASGYTFTSYAMHWVRQAPGQRLAWMGWINAGNGNTKYSEKFEGRVTITRDTSASTAYMELSSLRSEDTAVYYCARVAKYYYESGGYRASNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2000 - protein, 454 aa, Artificial Sequence
  chemically synthesized
QVQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAPPPTVGWYAPVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2001 - protein, 447 aa, Artificial Sequence
  chemically synthesized
QLQLQESGGGLVQPGGSLRLSCSASGISFRDYWMHWIRQTPGKGLVWVSRINPDGSSTSYADSVKGRFTISRDNSKNTLYLQMNSLRAEDTAVYYCAKVTGRRVGAHDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2002 - protein, 448 aa, Artificial Sequence
  chemically synthesized
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAFAQPGAETLNFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2003 - protein, 447 aa, Artificial Sequence
  chemically synthesized
QVQLQQSGPGLVKPSQTLSLTCAISGDSVSSKSAAWNWIRQSPSRGLEWLGRTYYRSKWNNDYALSVKSRITINPDTSKNQFSLQLKSVTPEDTALYYCVRQVAGGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2004 - protein, 450 aa, Artificial Sequence
  chemically synthesized
QVQLVQSGGGLVQPGRSLRLSCTASGFTFGDYAMSWFRQAPGKGLEWVSAISGSGGSTYYADSVKGRFTISRDNSKNTLYLQMNSLRAEDTAVYYCAKGSVYSGSYYMLIDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2005 - protein, 452 aa, Artificial Sequence
  chemically synthesized
QVQLQQSGPGLVRPSQTLSLTCVISGDSVSSGSAAWNWIRQSPSRGLEWLGRTYYRAKWYNEYAGSVKSRITISPDTSKNQFSLQLNSVTPEDTAVYFCTRQDKDNTRYSGLGVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2006 - protein, 450 aa, Artificial Sequence
  chemically synthesized
EVQLVETGGGLVQPGGSLRLSCAASEFTLRNYGVSWVRQAPGKGLEWVSGMSGSGYSTYYADSVKGRFTISRDSSKNTLFLQMDSLRAEDTAIYYCARGPRMWSSGIDAFDIWGHGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2007 - protein, 443 aa, Artificial Sequence
  chemically synthesized
QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2008 - protein, 449 aa, Artificial Sequence
  chemically synthesized
QVQLQQSGPGLLKPSQTLSLTCAISGDSVSSNTATWNWIRQSPSRGLEWLGRTYYRSKWYKDNALSVKSRITINPDTSKNQFSLQLNSVTPEDTAVYYCAGGRAGIAAFDIWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2009 - protein, 447 aa, Artificial Sequence
  chemically synthesized
QVQLVQSGGGLIQPGGSLRLSCAASGFTVSSNYMSWVRQAPGKGLEWVSLIYSDGRTNYADSVKGRFTISRDNSKNTLYLQMNSLRAEDTAVYYCAKGALQGEWRRFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2010 - protein, 453 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCTRTNQGYGGNSGVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2011 - protein, 447 aa, Artificial Sequence
  chemically synthesized
QVQLQQSGPGLVKPSQTLSLTCAISGDSVSGNSAAWNWIRQSPSRGLEWLGRTYYRSKWYNDYAVSVKSRITINPDTSKNQFSLQLNSVTPEDTAVYYCARIVGGAVDCWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2012 - protein, 451 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVRVGATTVYDSWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2013 - protein, 456 aa, Artificial Sequence
  chemically synthesized
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGGSSPYYDSSGLLPWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2014 - protein, 446 aa, Artificial Sequence
  chemically synthesized
QVQLQESGGGLVQPGGSLRLSCAASGFTFSSYAMHWVRQAPGKGLEYVSAISSNGGSTYYANSVKGRFTISRDNSKNTLYLQMGSLRAEDMAVYYCARAKFWTYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2015 - protein, 449 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGGSGSYYKRFFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2016 - protein, 454 aa, Artificial Sequence
  chemically synthesized
EVQLVQSGAEVRKPGASVKVSCKASGYTFTSYAISWVRQAPGQGLEWMGWISAYDGNTNYAQKLQGRVTMTTDTSTSTAYMEVRSLRSDDTAVYYCARDGTVRRVVGATTPGNFDYRGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2017 - protein, 451 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDLNRGYCSGGSCFGYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2018 - protein, 447 aa, Artificial Sequence
  chemically synthesized
QVQLQESGGGLVQPGGSLRLSCAASGFTFSSYAMSWVRQAPGKGLEWVSYISSSGTTIYYADSVKGRFTVSRDNAKNSLYLQMNSLRAEDTAVYYCARDYSSSGECFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2019 - protein, 447 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDQAAMVGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2020 - protein, 450 aa, Artificial Sequence
  chemically synthesized
QVTLKESGGGVVQPGRSLRLSCAASGFIFSNYAIHWVRQAPGKGLEWVAVISYDGSNKYYADSVKGRFTISRDNSKNTLYLQMNSLRAEDTAVYYCARTFAGYSSKLGYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 2021 - DNA, 1353 bp, Artificial Sequence
  chemically synthesized
gaagtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggctccttgtcccgaagtggctggtacgccggactctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2022 - DNA, 1353 bp, Artificial Sequence
  chemically synthesized
cagatcaccttgaaggagtctgggggaggcgtggtccagcctgggaggtccctgagactctcctgtgcagcctctggattcaccttcagtagttatagcatgaactgggtccgccaggctccaggcaaggggctgcagtgggtggcaattatatcagatgatggaagtaagagttactacgcagactccgtgcagggccgattcaccatctccagagacaattcgaggaacacagtatttctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2023 - DNA, 1350 bp, Artificial Sequence
  chemically synthesized
gaagtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggccgagggtatagcagcagtcggctctactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2024 - DNA, 1341 bp, Artificial Sequence
  chemically synthesized
caggtcaccttgaaggagtctgggggaggcttggtccggcctggagggtccctgagactctcctgtgaagcctctggattcaccttcagtgacccctacatggactgggtccgccaggctccaggcaaggggctggagtgggttggccgaattacaaataagcgtaccggttacgccacaacatatgccgcgtctgtgaaggacagattcaccatctcaagagatgattcaaggaagtcagtatatctgcaaatgaacagcctgaagaccgaggacacggccgtatattattgtgcaacagatgtcagtgggtccttcgcggcctacgggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2025 - DNA, 1338 bp, Artificial Sequence
  chemically synthesized
gaggtccagctggtacagtctgggggaggcgtggtccagcctgggaggtccctgagactctcctgtgcagcgtctggattcaccttcagtagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgggagagggcggagcagtggctggtactgtctactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2026 - DNA, 1329 bp, Artificial Sequence
  chemically synthesized
caggtccagctggtgcagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacgagtatttctactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2027 - DNA, 1350 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagtaaatccggggagttatacgagggaggtgagcaactttgactactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2028 - DNA, 1344 bp, Artificial Sequence
  chemically synthesized
caggtacagctgcagcagtcaggtccagaattggtgaagccctcgcagaccctcacactcacctgtggcatctccggggacagtgtctctagcaacagtgttacttggaactgggtcaggcagtccccatcgagaggccttgagtggctgggaaggacttactaccggtcccagtggtattataattatgcggtgtctgtgaaaagtcgaataaccatcagcccagacacatccaagaaccagttctccctgcagttgaattctgtgactcccgaggacacggctgtctattactgtgcaaccaggggacataactacggtgtagattactggggcccggggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2029 - DNA, 1341 bp, Artificial Sequence
  chemically synthesized
caggtgcagctggtgcagtctgggggaggcttggtaaagcctggggggtcccttagactctcctgtgcagcctctggattcactttcagtaacgcctggatgagctgggtccgccaggctccagggaaggggctggagtgggtttgccgtattaaaagcaaaactgatggtgagacaacagactacgctgcacccgtgaaaggcagattcaccatctcaagagatgattcaaaaaacacgctgtatctgcaaatgaacagcctgaaaactgaggacacagccgtgtatcactgtaccacaggggtgggatggtcgcccttccaatactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2030 - DNA, 1362 bp, Artificial Sequence
  chemically synthesized
gaggtccagctggtacagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacgacaaaatagcagcagctggattcacatactggtacttcgatctctggggccgtggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2031 - DNA, 1335 bp, Artificial Sequence
  chemically synthesized
caggtgcagctggtgcagtctggggctgaggtgaagaagcctggggcctcagtgaaggtctcctgcaaggcttctggatacaccttcgccgcctattatttacactgggtgcgacaggcccctggacaaggccttgagtggatggggcggatcagccctggtaacggtgtcacaagttatgcacagaaatttcagggcagagtcaccatgaccggggacacgtccattaacacagtctacatgcaactgaacaatttgatttctggcgacacggccgtatattactgtgcgagagaggctgccgacgacccgtttgaccattggggccagggagccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2032 - DNA, 1326 bp, Artificial Sequence
  chemically synthesized
gaagtgcagctggtgcagtctgggggaggcgtggtccagcctgggaggtccctgacactctcctgtgcagcctctggattcaccttcagttcccatcttatgcactgggtccgccaggctccaggcaaggggctggagtgggtggcagttatatcatatgatggaactagtaaatattacggagactccgtgaagggccgcttcaccatctccagagacaattccaagaacacgttgtatctgcaaatgaacagcctgcgagctgaagacacggctatatattactgtgcgaaagcagattataaatatgactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2033 - DNA, 1356 bp, Artificial Sequence
  chemically synthesized
gaggtgcagctggtgcagtctgggggaggcttggtcaagcctggagggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactactcatagacgcccaatttacgatattttgactggttttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2034 - DNA, 1344 bp, Artificial Sequence
  chemically synthesized
cagctgcagctgcaggagtccgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggatactatggttcggggagttattccctggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2035 - DNA, 1365 bp, Artificial Sequence
  chemically synthesized
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggctgtgtattactgtgcgagagatcggcgttactatgatagtagtggttattatcccgcctactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2036 - DNA, 1347 bp, Artificial Sequence
  chemically synthesized
gaagtgcagctggtgcagtctgggggaggcctggtcaagcctggggggtccctgagactctcctgtgcagcctctggattcaccttcagtagctatagcatgaactgggtccgccaggctccagggaaggggctggagtgggtttcatacattagtagtagtggtagttacacaaactacgcagactctgtgaagggccgattcaccatctccagagacaacgccaagaactcactgtatctgcaaataaacagcctgagagccgaggacacggccatttattactgtgcgagagacgggggctatgatagtagtggttttcactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2037 - DNA, 1368 bp, Artificial Sequence
  chemically synthesized
caggtacagctgcagcagtcaggtccaggactggtgaagccctcgcagaccctctcactcacctgtgccatctccggggacagtgtctctaacaacagggctgcttggaactggatcaggcagtcgccatcgagaggccttgagtggctgggaaggacatactacaggtccaagtggtataatgaatatgcagtctctgtgaaaagtcgaataaccatcaacccagacacatccaagaaccagttctccctgcagctgaactctatgactcccgaggactcggctgtgtattactgtgcaattttgcctagtagtggttatctacaggaccaccactactacggtatggacgtctggggccaagggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2038 - DNA, 1347 bp, Artificial Sequence
  chemically synthesized
gaggtgcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacacggccgtgtattactgtgcgagagccgcggtgggggatggatacagctatggtcggctcgattggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2039 - DNA, 1362 bp, Artificial Sequence
  chemically synthesized
gaggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccctcgtattactatgatagtagtggttactttacctggtacttcgatctctggggccgtggcaccctggtgaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2040 - DNA, 1347 bp, Artificial Sequence
  chemically synthesized
gaggtccagctggtacagtctggagctgaggtgaagaagcctggggcctcagtgaaggtctcctgcaaggcttctggttacacctttaccagctatggtatcagctgggtgcgacaggcccctggacaagggcttgagtggatgggatggatcatccctatctttggtatagcaaactacgcacagaagttccagggcagagtcacgattaccgcggacaaatccacgagcacagcctacatggagctgagcagcctgagatctgaggacacggccgtgtattactgtgcgagagaactatacaactatggttcaaaggactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2041 - DNA, 1350 bp, Artificial Sequence
  chemically synthesized
gaagtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcggtacttgggatacagctatggttacgggctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2042 - DNA, 1353 bp, Artificial Sequence
  chemically synthesized
gaagtgcagctggtgcagtctggagcagaggtgaaaaagcccggggagtctctgaagatctcctgtaagggttctggatacagctttaccagctactggatcgcctgggtgcgccagatgcccgggaaaggcctggagtggatgggggtcatctatcctggtgactctgataccagatacagcccgtccttccaaggccaggtcaccatctcagccgacaagtccatcaataccgcctacctgcagtggagcagcctgaaggcctcggacaccgccatgtattactgtgcgagaccccattacgatattttgactggttcccgggcgccctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2043 - DNA, 1341 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccgagtggaatccaaggatgggtactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2044 - DNA, 1350 bp, Artificial Sequence
  chemically synthesized
gaggtgcagctggtggagtctgggggaggcgtggtccagcctgggaggtccctgagactctcctgtgcagcctctggattcactttcactgatgcctggatgaactgggtccgccaggctccagggaaggggctggagtggattggccgtgttaaaaacaaagctgatggtgagacaacggactacgctgcacccgtcaaaggcagaatcaccatctcaagagatgatgcaaagaacactctgtatgtgcaaatgaacagcctgaaaaccgaggacacagccgtgtattattgtaccgctgacctgcgactttctacgtgggatgcttatgatttctggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2045 - DNA, 1332 bp, Artificial Sequence
  chemically synthesized
cagatcaccttgaaggagtctgggggaggcttggtccagcctggggggtccctaagactctcttgtacagtctcaggattcacctttagtaacaattggatgacctgggtccgccagactccagggaaggggctggagtgggtggccaacataaagcaagatggaactgagaaacactatgtggactctgtgaagggccgattcaccatctccagagacaacgccgagaactcactgtatctgcagatgaacagcctgagaggtgaggacacggccgtgtattattgtgcgagaaacagtcaacgttcgtttgactactggggccagggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2046 - DNA, 1344 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttaggggatccccggggtggtattttgaactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2047 - DNA, 1356 bp, Artificial Sequence
  chemically synthesized
gaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcccggtcgagcccctggggggagttatcgttataccagggggcttttgatatctggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2048 - DNA, 1344 bp, Artificial Sequence
  chemically synthesized
cagatcaccttgaaggagtctgggggaggcttggtacagcctggcaggtccctgagactctcctgtgcagcctctggattcacctttgatgattatgccatgcactgggtccggcaagctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataacgatttttggagtgggaaagtctttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2049 - DNA, 1344 bp, Artificial Sequence
  chemically synthesized
gaagtgcagctggtgcagtctgggggaggcttggtacagcctggggggtccctgagactctcctgtgcagcctctggattcaccttcagtagttatagcatgaactgggtccgccaggctccagggaaggggctggagtgggtttcatacatcagtagtactagtagtaccatatactacgcagactccgtgaagggccgattcaccatctccagagacaattccaagaatatgctgtttctacaaatgaacagcctgagagctgaggacacggctgtgtattactgtgcgaaagaagggggcagtggctggcgccactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2050 - DNA, 1350 bp, Artificial Sequence
  chemically synthesized
caggtcaccttgaaggagtctgggggaggcgtggtccagcctgggaggtccctgagactgtcctgtgcagcctctggattcaccttcagcagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagattattgtagtagtaccagctgccagaactggttcgacccctggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2051 - DNA, 1338 bp, Artificial Sequence
  chemically synthesized
caggtccagctggtgcagtctgggggaggcttggtacagcctggggggtccctgagactctcctgtgcagcctctggattcacctttagcaactatgtcatgagctgggtccgccaggctccagggaaggggctggagtgggtctcagctattagtggtattggtgatactacatactacgcggactccgtgaagggccgattcaccatctccagagacaacgccaagaacacgctgtatctgcaaatgaacagtctgagagccgaggacacggctgtgtattactgtgcaagagggcgcgtggcgggggatgcttttgatatctggggccaagggacaatggtgaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2052 - DNA, 1350 bp, Artificial Sequence
  chemically synthesized
cagctgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcaaggggcagcagctggtaccctggggtactttgactactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2053 - DNA, 1350 bp, Artificial Sequence
  chemically synthesized
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtacgagaggaatctatgatagtagtggttcttccaatccctttgactcctggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2054 - DNA, 1353 bp, Artificial Sequence
  chemically synthesized
gaggtgcagctggtgcagtctggggctgaggtgaagaagcctggggcctcagtgaagatttcctgcgaggcttctggatacaccttcactgattatgctatacattgggtgcgccaggcccccggacaaagacttgagtggatgggatggatcaacgctggcgatggtggcacaaaaagttcacgggagttccagggcagagtcaccattaccagggacacatccgcgaccacagcctacatggaggtgagcagtctgagatctgaagacacggctgtctattactgtgcgagaggatattgtagtggtggtagctgcccaggaacggattttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2055 - DNA, 1347 bp, Artificial Sequence
  chemically synthesized
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatggtgtaggagggagagatggctacaattttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2056 - DNA, 1338 bp, Artificial Sequence
  chemically synthesized
gaagtgcagctggtgcagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagcccccctagcagcagatggctactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2057 - DNA, 1347 bp, Artificial Sequence
  chemically synthesized
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagcccgggggctacagtacctaatctggtacttcgatctctggggccgtggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2058 - DNA, 1350 bp, Artificial Sequence
  chemically synthesized
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagcccgggtatggttcggggagttattactgccccgcttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2059 - DNA, 1341 bp, Artificial Sequence
  chemically synthesized
gaggtccagctggtacagtctgggggaggcctggtcaagcctggggggtccctgagactctcctgtgcagcctctggattcaccttcagcagctatgctatcagctgggtgcgacaggcccctggacaagggcttgagtggatgggagggatcatccctatgtatggtacagcaaactacgcacagaagttccagggcagagtcacgattaccgcggacgaatccacgagcacagcctacatggaactgagcagcctgagatctgaggacacggccctctattactgtgcgagagaagctaagtggggaatgtactactttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2060 - DNA, 1353 bp, Artificial Sequence
  chemically synthesized
gaggtgcagctggtggagtccgggggaggcgtggtccagcctgggaggtccctgagactctcctgtgcagcctctggattcaccttcagtagctatgctatacactgggtccgccaggctccaggcaaggggctggagtgggtggcaattatatcagatgatggaagtaagagttactacgcagactccgtgcagggccgattcaccatctccagagacaattcgaggaacacagtatatctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2061 - DNA, 1335 bp, Artificial Sequence
  chemically synthesized
cagatgcagctggtgcaatctggggctgaggtgaagaagcctggggcctcagtgaaggtctcctgcacggcttctggatacaccttcaccagttctgatatcaactgggtgcgacaggccactggacaagggcttgagtggatgggatggatgaaccctaacagtggtaacaccggctatgcagagaagttccagggcagggtcaccatgaccagcgactcctccataagcaccgcctacatggagttgagaagcctgaccactgaggacacggccgtatattactgtgcgagaggtgggggtgcgagctatactgactcctggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2062 - DNA, 1359 bp, Artificial Sequence
  chemically synthesized
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtaccgctaaggggggctacgtcggatacagctatggaccttttgggggctactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2063 - DNA, 1350 bp, Artificial Sequence
  chemically synthesized
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggggggactatggttcggggtttcggatttaactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2064 - DNA, 1359 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccggcgggctatgatagggccgcttccgcgacttgtcgggtacttcgatctctggggccgtggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2065 - DNA, 1353 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccgccccgccccatcctgggttaaaacccgtaactggttcgacccctggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2066 - DNA, 1338 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggctagcagtggctggaactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2067 - DNA, 1353 bp, Artificial Sequence
  chemically synthesized
caggtgcagctgcaggagtccggtccaggactggtgaagccctcgcagaccctctcactcacctgtgccatctccggggacagtgtctctagcaacaatgctgcttggaactggatcaggcagtccccatcgagaggccttgagtggctgggaaggacattctacaggtccaagtggtataatgactatgcagtttctgtgaaaagtcgactaaccgtcaacccagacacatccaagaaccagttctccctgcggttgaactctgtgagtcccgaggacacggctgtgtattactgtgcaagagggggaagatataccaagggagggtactttgacgactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2068 - DNA, 1350 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagattggatagcagtggccgtggtggttactttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2069 - DNA, 1362 bp, Artificial Sequence
  chemically synthesized
gaggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagagttggtgggtaccagctctccttattactactactactacggtatggacgtctggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2070 - DNA, 1335 bp, Artificial Sequence
  chemically synthesized
cagctgcagctgcaggagtcggggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagactattactatggttcggggagttctccctggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2071 - DNA, 1356 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccggccatattgtagtagtaccagctgctacccagagtggttcgacccctggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2072 - DNA, 1362 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaattaaggggtatagattactatgatagtagtggttaccaacgggggtttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2073 - DNA, 1338 bp, Artificial Sequence
  chemically synthesized
caggtgcagctgcaggagtccggcccaggactggtgaagccttcggagaccctgtccctcacctgcactgtctctggtggctccatcagtagttactactggagctggatccggcagcccccagggaagggactggagtggattggctatatctattacactgggagcaccaactacaacccctccctcaagagccgagtcaccatatcagtagacacgtccaagaaccagttctccctgaagctgagctctgtgaccactgcggacacggccgtgtattactgtgcgagaggtgggaggggggatggggccgcttttgacatctggggccaagggacaatggtcaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2074 - DNA, 1350 bp, Artificial Sequence
  chemically synthesized
caggtgcagctggtgcaatctgggggaggcgtggtccagcctgggaggtccctgagactctcctgtgcagcgtctggattcaccttcagcagctctgccatgcactgggtccgccaggctccaggcaagggactggagtgggtggcaatgatttggcatgatgagagtaagaaatactatgcagactccgtgaagggccgattcactatctccagagacaattccaagaacacgctgtatctgcaaatgaacagcctgagagctgaggacacggctgtgtattactgtgcgagaccccccgacggtggtaactccggtcgctggtacttcgatctctggggccgtggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2075 - DNA, 1368 bp, Artificial Sequence
  chemically synthesized
cagatgcagctggtgcaatctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacaagaacgtccgaaaacatgactacggtgaccacccctacggggggtactttgactactggggccagggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2076 - DNA, 1335 bp, Artificial Sequence
  chemically synthesized
gaggtccagctggtacagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagtggcgggagctacttccctatggtactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2077 - DNA, 1344 bp, Artificial Sequence
  chemically synthesized
caggtacagctgcagcagtcaggtccaggactggtgaagccctcgcagagcctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaagagtcgaataaccatcaaaccagacacatccaagaaccagttctccctgcagctgaactctgtgactcccgaggacacggctgtgtattactgtacaaggctagctaattccgacggtgtggacgtctggggccaagggacaatggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2078 - DNA, 1341 bp, Artificial Sequence
  chemically synthesized
caggtacagctgcagcagtcaggtccaggactggtgaagccctcgcagaccctctcactcacctgtgccatctccggggacagtgtctctagcgacagtgctgtttggacctggatcaggcagtccccatcgagaggccttgagtggctgggaaggacatactacaagtcgaagtggtataatgattatgcagcatctgtgaaaagtcgaataaccatcaacccagacacatccaagaaccagttctccctgcacctgaactctgtgactcccgaggacacggctgtgtattactgtgcaagaggtgtaacccggacctttgactactggggccaggggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2079 - DNA, 1338 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcagaaggcaatgggccgttcgacccctggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2080 - DNA, 1341 bp, Artificial Sequence
  chemically synthesized
cagatcaccttgaaggagtctgggggaggcgtggtccagcctgggaggtccctgagactctcctgtgtagcctctggattcaccttcagtacctatcccatgcactgggtccgccaggctccaggcaaggggctggagtgggtggcagttatatcatatgatggacgtaatgaatactacgcagactccgtgaagggccgattcaccatctccagagacaattccaaaaacacgctgtatctgcaaatgaacagtctgcgagctgaagacacggctgtctattattgtgcgactcgggatacacctttggttggggtttcgatatactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2081 - DNA, 1344 bp, Artificial Sequence
  chemically synthesized
cagatgcagctggtgcaatctgggggaggcctggtcaaggctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaatcgggcgggttacggtgactacagacacttccagcactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2082 - DNA, 1338 bp, Artificial Sequence
  chemically synthesized
gaggtgcagctggtgcagtctgggggaggcgtggtccagcctggggggtccctgagactctcctgtgcagcgtctggattcaccttcagtagctatggcatgcactgggtccgccaggctccaggcaaggggctggagtgggtggcatttatatcatatgatggaagtaataaatactacgcagactccgtgaagggccgattcaccatctccagagacaattccaagaacacgctgtatctgcaaatgaacagcctgagagccgaggacacggccgtatattactgtgcgacaacaggggaccgcttccaagagtttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2083 - DNA, 1347 bp, Artificial Sequence
  chemically synthesized
cagatgcagctggtgcagtctgggggagtcttgcttcagccagggcggtccctgagactctcctgtacagcttctggattcacctttgctgcttataatatcaactggttccgccagggtcctgggggggggctggagtgggtaggtttcattagagccaacgctgatagtgggacaacagagtacgccgcgtctgtgaaaggcagattcttcatctcaagagatgattccagaagcaccgcctacctgcaaatgactagccttaaaaccgaggacacagccgtttattactgtgccagagatgatcggggtcggggagatgactttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2084 - DNA, 1344 bp, Artificial Sequence
  chemically synthesized
caggtgcagctggtgcaatctgggggaggcttggtacagcctggggggtccctgagactctcctgtgcagcctctggattcacctttagcagctatggcatgacgtgggtccgccaggctccagggaaggggctggagtgggtctcaactattagtggtaatggtgttggcacatactacccagactccgtgaaggaccggttcaccatctccagagacagttccaagaacacggtgtatctgcaaatgaacagcctgagagccgaggacacggccgtatattactgtgtgaaacatggtagggccggaataaactggtacttcgatctctggggccgtggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2085 - DNA, 1344 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggggagggctttgggcttttgatatctggggccaagggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2086 - DNA, 1332 bp, Artificial Sequence
  chemically synthesized
gaggtccagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacaagatcggcagctgtccttactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2087 - DNA, 1344 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccggatagcagcagtcaatgttttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2088 - DNA, 1338 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaagcagtggctggtcactgcctgaagactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2089 - DNA, 1347 bp, Artificial Sequence
  chemically synthesized
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacggatgtgaacccggagctactgggggcgggatttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2090 - DNA, 1350 bp, Artificial Sequence
  chemically synthesized
caggtcaccttgaaggagtctgggggaggcttggtccagcctggagggtccctgagactctcctgtgcagcctctggattcaccttcagtgaccagtacatggactgggtccgccaggctccagggaaggggctggagtgggttggccgtgttagaaacaaagctaacagttacaccacagaatacgccgcgtctgtgaaaggcagattcaccatctcaagagatgattcaaagaactcactgtatctgcaaatgaatagtctgaacaccgaggacacggccatgtatttctgtgctagtagtctcaatagtgggggctaccgatgcttccatcactggggccagggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2091 - DNA, 1350 bp, Artificial Sequence
  chemically synthesized
caggtccagctggtgcagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaaagcgccgaggggtgtagtaccagctgctatgcgggggggctactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2092 - DNA, 1353 bp, Artificial Sequence
  chemically synthesized
caggtgcagctgcaggagtcggggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattggtgggcaatagtgggagctactatccgtttgggtactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2093 - DNA, 1368 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctcggtgaccgccgcggacacggctgtgtattactgtgcgagaggccggtcccttccctaccgggggttggctcctagatctttcggaggatactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2094 - DNA, 1344 bp, Artificial Sequence
  chemically synthesized
caggtgcagctgcaggagtcggggggaggcttggtacggcctggagggtccctgagactctcctgtggagactctggattcaacttcagtggatatgaaatgaactgggtccgccaggctccagggaaggggctggagtgggtttcatacgtcagtactagtggtagtaccagatactacgcagactctgtgaagggccgatttaccatctccagagacaacgccaagaacaccctgtatttgcaaatgaacagtctgagagtcgaggacacggctgtgtattactgtgcaagaggacggactcactggggcccccaggactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2095 - DNA, 1353 bp, Artificial Sequence
  chemically synthesized
caggtgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggaggaatgtattactatggttcggggagctcgtactttgactactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2096 - DNA, 1344 bp, Artificial Sequence
  chemically synthesized
caggtgcagctggtgcaatctgggggaggcttggtacagcctggggggtccctgagactctcctgtgcagcctctggattcacctttagcagctatgccatgagctgggtccgccaggctccagggaaggggctggaatgggtctcaggtattagtggtagtggtggtagcacatactacgcagactccgtgaagggccggttcaccatctccagagacaattccaagaacatgctgtttctgcaaatgaacagcccgagagccgaggacacggccgtatattactgtgcgaagaaaatagcagcagctggtaagcaacctgttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2097 - DNA, 1374 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaggaaggtgtatgattacgtttgggggagttatcgcctccccgggtcggtatcgtactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2098 - DNA, 1338 bp, Artificial Sequence
  chemically synthesized
caggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccggggagagcagctcgtccagactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2099 - DNA, 1356 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggccccggggcagtggctggtactaagccaaagtactactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2100 - DNA, 1350 bp, Artificial Sequence
  chemically synthesized
gaggtccagctggtgcagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggccacgtattactatgatagtagtggttataggtttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2101 - DNA, 1329 bp, Artificial Sequence
  chemically synthesized
gaggtccagctggtacagtctgggggaggcttggtagaaccgggggggtcccttagactctcctgtgcagcctctcgattcactttcagtgacgcctggatgagctgggtccgccaggctccaggtaaggggctggagtgggttggccgtattaaaagcaaaataagtggtgggacaacagactacgctgcacccgtgcaaggcagattcaccatctcaagagatgattcaaaaaacacgctgtatctgcaaatggacagcctgaaaaccgaggacacagccgtgtattactgtgcgaaccgaaacttaggctactggggccagggcaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2102 - DNA, 1362 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccatgaccacagacacatccacgagcacagcctacatggagctgaggagcctgagatctgacgacacggccgtgtattactgtgcgagagctcgttactatgatagtagtggttatattgccccatcgggttactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2103 - DNA, 1347 bp, Artificial Sequence
  chemically synthesized
caggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatggccccgccgttgatggtgctgaatacttccagcactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2104 - DNA, 1350 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgcgaggccttgagtggctgggaaggacttactacaggtccaagtggtataatgattatgcagtatctctgaaaagtcgaataaccatcaacccggacacatccaagaaccagttctccctgcagctgaactctgtgactcccgaggacacggctgtatattactgtgcaagtttggcgagtggttccccccctccgggggactactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2105 - DNA, 1338 bp, Artificial Sequence
  chemically synthesized
caggtcaccttgaaggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaaaaaatactatgcaaactccgtgaagggccgattcaccatctccagagacaattccaagaacacgttgtatctgcaaatgaaaagtctgagagctgaggacacggctatgtattactgtgcgaaaggccctatagtgggagcgactatggactactggggccagggagccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2106 - DNA, 1335 bp, Artificial Sequence
  chemically synthesized
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatggtacggtgactacggccttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2107 - DNA, 1365 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgcgtggatgggatggatcaacgctggcaatggtaacacaaaatattcagagaagttcgaaggcagagtcaccatcaccagggacacatccgcgagcacagcctacatggagctgagcagcctgagatctgaagacacggctgtgtattactgtgcgagggtcgccaaatattattacgagagtggtggttatcgggcctccaactggttcgacccctggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2108 - DNA, 1362 bp, Artificial Sequence
  chemically synthesized
caggtgcagctgcaggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagcgccccctccgactgttggctggtacgcccccgtctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2109 - DNA, 1341 bp, Artificial Sequence
  chemically synthesized
cagctgcagctgcaggagtccgggggaggcttagttcagccgggggggtccctgagactctcctgctcagcctctggaatcagcttcagagattactggatgcactggatccgccaaactccagggaaggggctggtgtgggtctcacgtattaatcctgatgggagtagcacaagctacgcggactccgtgaagggccgattcaccatctccagagacaattccaagaacacgctgtatctgcaaatgaacagcctgagagctgaggacacggctgtgtattactgtgcgaaagttacgggacggagagtgggagcccatgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2110 - DNA, 1344 bp, Artificial Sequence
  chemically synthesized
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcctttgcccagccgggcgctgagacgttgaacttcgatctctggggccgtggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2111 - DNA, 1341 bp, Artificial Sequence
  chemically synthesized
caggtacagctgcagcagtcaggtccaggactggtgaagccctcgcagaccctctcactcacctgtgccatctccggggacagtgtctctagcaaaagtgctgcttggaactggatcaggcagtccccatcgagaggccttgagtggctgggaaggacatactacaggtccaaatggaataatgattatgcattatctgtgaaaagtcgaataaccatcaacccagacacatccaagaaccagttctccctgcagctgaagtctgtgactcccgaggacacggctctgtattactgtgtaagacaagtcgcgggcggtatggacgtctggggccaagggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2112 - DNA, 1350 bp, Artificial Sequence
  chemically synthesized
caggtgcagctggtgcaatctgggggaggcttggtacagccagggcggtccctgagactctcctgtacagcttctggattcacctttggtgattatgctatgagctggttccgccaggctccagggaaggggctggagtgggtctcagctattagtggtagtggtggtagcacatactatgcagactccgtgaagggccgattcaccatctccagagacaattccaagaacacgctgtatctgcaaatgaacagcctgagagctgaggacacggctgtgtattactgtgcgaaaggatcggtatatagtgggagctactatatgctcattgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2113 - DNA, 1356 bp, Artificial Sequence
  chemically synthesized
caggtacagctgcagcagtcaggtccaggactggtgaggccctcgcagaccctctcactcacctgtgtcatctccggggacagtgtctctagcggcagtgctgcttggaactggatcaggcagtccccatcgagaggccttgagtggctgggaaggacatattatagggccaagtggtataatgaatatgcagggtctgtgaaaagccgaataaccatcagtccggacacatccaagaaccagttctccctgcaactgaactctgtgactcccgaggacacggctgtgtatttctgtacaagacaagacaaagacaacacgagatattccggtttgggcgtctggggccaagggaccacggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2114 - DNA, 1350 bp, Artificial Sequence
  chemically synthesized
gaggtgcagctggtggagaccgggggaggcttagttcagcctggggggtccctgagactctcctgtgcagcctctgaattcacccttaggaactatggcgtgagctgggtccgccaggctccagggaaggggctggagtgggtctcaggtatgagtggtagtggttatagtacatactacgcagactccgtgaagggccggttcaccatctccagagacagttccaagaacacgctgtttctgcaaatggacagcctgagagccgaggacacggccatatattactgtgcgagagggccccgaatgtggagcagtggcattgatgcttttgatatctggggccacgggacaatggtgaccgtctcttcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2115 - DNA, 1329 bp, Artificial Sequence
  chemically synthesized
caggtgcagctacagcagtggggcgcaggactgttgaagccttcggagaccctgtccctcacctgcgctgtctatggtgggtccgtcagtggttactactggagctggatccgccagcccccagggaaggggctggagtggatgggggaaatccatcatagtggaagcaccaactacaacccgtccctcaagagtcgagtcaccatatcactagacacgcccaagaaccagttctccctgaagctaagctctgtgaccgccgcggacacggctgtatattactgtgcgagacgggattgggcaggaaaaagggtctggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2116 - DNA, 1347 bp, Artificial Sequence
  chemically synthesized
caggtacagctgcagcagtcaggtccaggactattaaagccctcgcagaccctctcactcacctgtgccatctccggggacagtgtctctagcaacactgctacttggaactggatcaggcagtccccatcgagaggccttgagtggctgggaaggacatactacaggtccaagtggtataaggataatgcactgtctgtgaaaagtcgaataaccatcaacccagacacatccaagaaccagttctccctgcagctgaactctgtgactcccgaggacacggctgtgtattactgtgcaggaggtcgggctggtattgccgcttttgatatctggggccaagggaccacggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2117 - DNA, 1341 bp, Artificial Sequence
  chemically synthesized
caggtgcagctggtgcaatctggaggaggcttgatccagcctggggggtccctgagactctcctgtgcagcctctgggttcaccgtcagtagcaactacatgagctgggtccgccaggctccagggaaggggctggaatgggtctcacttatttatagtgatggtcgcacaaactatgcagactccgtgaagggccgattcaccatctccagagacaattccaagaacacgctgtatctgcaaatgaacagcctgagagccgaggacacggccgtatattactgtgcgaagggggccctacagggcgaatggcggagatttgactactggggccagggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2118 - DNA, 1359 bp, Artificial Sequence
  chemically synthesized
caggtgcagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataatgattatgcagtatctgtgaaaagtcgaataaccatcaacccagacacatccaagaaccagttctccctgcagctgaactctgtgactcccgaggacacggctgtgtattactgtacaagaaccaaccagggatacggtggtaactccggggtatttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2119 - DNA, 1341 bp, Artificial Sequence
  chemically synthesized
caggtgcagctacagcagtcaggtccaggactggtgaagccctcgcagaccctctcactcacctgtgccatctccggggacagtgtctctggcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagttgaattctgtgactcccgaggacacggctgtgtattactgtgcgaggatagtgggaggtgccgttgactgctggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2120 - DNA, 1353 bp, Artificial Sequence
  chemically synthesized
gaggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagttagagtgggagctactactgtttacgacagctggttcgacccctggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2121 - DNA, 1368 bp, Artificial Sequence
  chemically synthesized
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggggggtccagcccatactatgatagtagtggtttactaccctggtacttcgatctctggggccgtggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2122 - DNA, 1338 bp, Artificial Sequence
  chemically synthesized
caggtgcagctgcaggagtcggggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagctaagttttggacatactactttgactactggggccagggaaccctggtgaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2123 - DNA, 1347 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcggtggttcggggagttattataagaggttctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2124 - DNA, 1362 bp, Artificial Sequence
  chemically synthesized
gaggtgcagctggtgcagtctggagctgaggtgaggaagcctggggcctcagtgaaggtctcctgcaaggcttctggttacacatttaccagttatgccatcagctgggtgcgacaggcccctggacaagggcttgagtggatggggtggatcagcgcttacgacggtaacacaaactatgcacagaagctccagggcagagtcaccatgaccacagacacatccacgagcacagcctacatggaggtgaggagcctgagatctgacgacacggccgtgtattactgtgcgagagatggtacggtccgaagggtagtgggagctactacccctggaaactttgactacaggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2125 - DNA, 1353 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgaatcgaggatattgtagtggtggtagctgctttggctactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2126 - DNA, 1341 bp, Artificial Sequence
  chemically synthesized
caggtgcagctgcaggagtctgggggaggcttggtacagccgggggggtccctgagactctcctgtgcagcctctggattcacctttagcagctatgccatgagctgggtccgccaggctccagggaaggggctggagtgggtttcatacattagtagtagtggtactaccatatactacgcagactctgtgaagggccgattcaccgtctccagagacaatgccaagaactcactgtatctgcaaatgaacagcctgagagccgaggacacggccgtgtattactgtgcgagggattatagcagctcgggggagtgctttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2127 - DNA, 1341 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcaggcagctatggtaggctactttgactactggggccagggaaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2128 - DNA, 1350 bp, Artificial Sequence
  chemically synthesized
caggtcaccttgaaggagtctgggggaggcgtggtccagcctgggaggtccctgagactctcctgtgcagcctctggattcatcttcagtaactatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggacttttgcggggtatagcagcaaactggggtacttcgatctctggggccgtggcaccctggtcaccgtctcctcagcatccaccaaggggccttccgtgttccccctggccccttgctcccgctcgacctctgaatccaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaaccaagacctatacctgcaacgtcgaccacaagccctccaacaccaaagtggacaagcgcgtcgaatccaagtacggccccccttgtccgccttgtccagcccctgagttcctgggtggtccgtccgtgttcctcttcccgcccaagccgaaggacactctgatgatttcacgcaccccggaagtcacttgcgtggtcgtggacgtgtcgcaggaagatcccgaagtgcagttcaattggtacgtggatggggtcgaagtgcacaacgccaagaccaagcctagggaagaacagttcaactctacgtaccgggtggtgtccgtgctgaccgtgctgcaccaggactggctgaacggaaaggagtacaagtgcaaagtgtcaaacaagggcctcccttcatccatcgaaaagaccatcagcaaggccaagggtcaacctagggagccccaggtctacactttgccgcctagccaagaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactcccggctgactgtggacaagtcaagatggcaggagggaaacgtgttctcctgctccgtgatgcacgaagcgctgcacaaccattacacccagaaatcactgtcactttcgctgggaaaa

SEQ ID NO: 2129 - protein, 454 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGSLSRSGWYAGLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2130 - protein, 454 aa, Artificial Sequence
  chemically synthesized
QITLKESGGGVVQPGRSLRLSCAASGFTFSSYSMNWVRQAPGKGLQWVAIISDDGSKSYYADSVQGRFTISRDNSRNTVFLQMNSLRAEDTAMYYCARDRGTKWNQLNDVFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2131 - protein, 453 aa, Artificial Sequence
  chemically synthesized
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGRGYSSSRLYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2132 - protein, 450 aa, Artificial Sequence
  chemically synthesized
QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2133 - protein, 449 aa, Artificial Sequence
  chemically synthesized
EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2134 - protein, 446 aa, Artificial Sequence
  chemically synthesized
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEYFYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2135 - protein, 453 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVNPGSYTREVSNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2136 - protein, 451 aa, Artificial Sequence
  chemically synthesized
QVQLQQSGPELVKPSQTLTLTCGISGDSVSSNSVTWNWVRQSPSRGLEWLGRTYYRSQWYYNYAVSVKSRITISPDTSKNQFSLQLNSVTPEDTAVYYCATRGHNYGVDYWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2137 - protein, 450 aa, Artificial Sequence
  chemically synthesized
QVQLVQSGGGLVKPGGSLRLSCAASGFTFSNAWMSWVRQAPGKGLEWVCRIKSKTDGETTDYAAPVKGRFTISRDDSKNTLYLQMNSLKTEDTAVYHCTTGVGWSPFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2138 - protein, 457 aa, Artificial Sequence
  chemically synthesized
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRDDKIAAAGFTYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2139 - protein, 448 aa, Artificial Sequence
  chemically synthesized
QVQLVQSGAEVKKPGASVKVSCKASGYTFAAYYLHWVRQAPGQGLEWMGRISPGNGVTSYAQKFQGRVTMTGDTSINTVYMQLNNLISGDTAVYYCAREAADDPFDHWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2140 - protein, 445 aa, Artificial Sequence
  chemically synthesized
EVQLVQSGGGVVQPGRSLTLSCAASGFTFSSHLMHWVRQAPGKGLEWVAVISYDGTSKYYGDSVKGRFTISRDNSKNTLYLQMNSLRAEDTAIYYCAKADYKYDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2141 - protein, 455 aa, Artificial Sequence
  chemically synthesized
EVQLVQSGGGLVKPGGSLRLSCTASGFTFGDYAMSWVRQAPGKGLEWVGFIRSKAYGGTTEYAASVKGRFTISRDDSKSIAYLQMNSLKTEDTAVYYCTTHRRPIYDILTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2142 - protein, 451 aa, Artificial Sequence
  chemically synthesized
QLQLQESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTREDTMVRGVIPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2143 - protein, 458 aa, Artificial Sequence
  chemically synthesized
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARDRRYYDSSGYYPAYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2144 - protein, 452 aa, Artificial Sequence
  chemically synthesized
EVQLVQSGGGLVKPGGSLRLSCAASGFTFSSYSMNWVRQAPGKGLEWVSYISSSGSYTNYADSVKGRFTISRDNAKNSLYLQINSLRAEDTAIYYCARDGGYDSSGFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2145 - protein, 459 aa, Artificial Sequence
  chemically synthesized
QVQLQQSGPGLVKPSQTLSLTCAISGDSVSNNRAAWNWIRQSPSRGLEWLGRTYYRSKWYNEYAVSVKSRITINPDTSKNQFSLQLNSMTPEDSAVYYCAILPSSGYLQDHHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2146 - protein, 452 aa, Artificial Sequence
  chemically synthesized
EVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARAAVGDGYSYGRLDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2147 - protein, 457 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPSYYYDSSGYFTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2148 - protein, 452 aa, Artificial Sequence
  chemically synthesized
EVQLVQSGAEVKKPGASVKVSCKASGYTFTSYGISWVRQAPGQGLEWMGWIIPIFGIANYAQKFQGRVTITADKSTSTAYMELSSLRSEDTAVYYCARELYNYGSKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2149 - protein, 453 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGTWDTAMVTGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2150 - protein, 454 aa, Artificial Sequence
  chemically synthesized
EVQLVQSGAEVKKPGESLKISCKGSGYSFTSYWIAWVRQMPGKGLEWMGVIYPGDSDTRYSPSFQGQVTISADKSINTAYLQWSSLKASDTAMYYCARPHYDILTGSRAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2151 - protein, 450 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2152 - protein, 453 aa, Artificial Sequence
  chemically synthesized
EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2153 - protein, 447 aa, Artificial Sequence
  chemically synthesized
QITLKESGGGLVQPGGSLRLSCTVSGFTFSNNWMTWVRQTPGKGLEWVANIKQDGTEKHYVDSVKGRFTISRDNAENSLYLQMNSLRGEDTAVYYCARNSQRSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2154 - protein, 451 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGDPRGGILNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2155 - protein, 455 aa, Artificial Sequence
  chemically synthesized
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSPWGELSLYQGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2156 - protein, 451 aa, Artificial Sequence
  chemically synthesized
QITLKESGGGLVQPGRSLRLSCAASGFTFDDYAMHWVRQAPGKGLEWVSAISGSGGSTYYADSVKGRFTISRDNSKNTLYLQMNSLRAEDTAVYYCAKDNDFWSGKVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2157 - protein, 451 aa, Artificial Sequence
  chemically synthesized
EVQLVQSGGGLVQPGGSLRLSCAASGFTFSSYSMNWVRQAPGKGLEWVSYISSTSSTIYYADSVKGRFTISRDNSKNMLFLQMNSLRAEDTAVYYCAKEGGSGWRHYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2158 - protein, 453 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARDYCSSTSCQNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2159 - protein, 449 aa, Artificial Sequence
  chemically synthesized
QVQLVQSGGGLVQPGGSLRLSCAASGFTFSNYVMSWVRQAPGKGLEWVSAISGIGDTTYYADSVKGRFTISRDNAKNTLYLQMNSLRAEDTAVYYCARGRVAGDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2160 - protein, 453 aa, Artificial Sequence
  chemically synthesized
QLQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQGAAAGTLGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2161 - protein, 453 aa, Artificial Sequence
  chemically synthesized
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCTRGIYDSSGSSNPFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2162 - protein, 454 aa, Artificial Sequence
  chemically synthesized
EVQLVQSGAEVKKPGASVKISCEASGYTFTDYAIHWVRQAPGQRLEWMGWINAGDGGTKSSREFQGRVTITRDTSATTAYMEVSSLRSEDTAVYYCARGYCSGGSCPGTDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2163 - protein, 452 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGVGGRDGYNFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2164 - protein, 449 aa, Artificial Sequence
  chemically synthesized
EVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARAPLAADGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2165 - protein, 452 aa, Artificial Sequence
  chemically synthesized
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARARGLQYLIWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2166 - protein, 453 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCASPGMVRGVITAPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2167 - protein, 450 aa, Artificial Sequence
  chemically synthesized
EVQLVQSGGGLVKPGGSLRLSCAASGFTFSSYAISWVRQAPGQGLEWMGGIIPMYGTANYAQKFQGRVTITADESTSTAYMELSSLRSEDTALYYCAREAKWGMYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2168 - protein, 454 aa, Artificial Sequence
  chemically synthesized
EVQLVESGGGVVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2169 - protein, 448 aa, Artificial Sequence
  chemically synthesized
QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2170 - protein, 456 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2171 - protein, 453 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGTMVRGFGFNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2172 - protein, 456 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAMIGPLPRLVGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2173 - protein, 454 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPAPSWVKTRNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2174 - protein, 449 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREASSGWNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2175 - protein, 454 aa, Artificial Sequence
  chemically synthesized
QVQLQESGPGLVKPSQTLSLTCAISGDSVSSNNAAWNWIRQSPSRGLEWLGRTFYRSKWYNDYAVSVKSRLTVNPDTSKNQFSLRLNSVSPEDTAVYYCARGGRYTKGGYFDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2176 - protein, 453 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRLDSSGRGGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2177 - protein, 457 aa, Artificial Sequence
  chemically synthesized
EVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKELVGTSSPYYYYYYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2178 - protein, 448 aa, Artificial Sequence
  chemically synthesized
QLQLQESGGGLVQPGGSLRLSCAASGFTVSSNYMSWVRQAPGKGLEWVSVIYSGGSTYYADSVKGRFTISRDNSKNTLYLQMNSLRAEDTAVYYCARDYYYGSGSSPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2179 - protein, 455 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPYCSSTSCYPEWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2180 - protein, 457 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKLRGIDYYDSSGYQRGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2181 - protein, 449 aa, Artificial Sequence
  chemically synthesized
QVQLQESGPGLVKPSETLSLTCTVSGGSISSYYWSWIRQPPGKGLEWIGYIYYTGSTNYNPSLKSRVTISVDTSKNQFSLKLSSVTTADTAVYYCARGGRGDGAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2182 - protein, 453 aa, Artificial Sequence
  chemically synthesized
QVQLVQSGGGVVQPGRSLRLSCAASGFTFSSSAMHWVRQAPGKGLEWVAMIWHDESKKYYADSVKGRFTISRDNSKNTLYLQMNSLRAEDTAVYYCARPPDGGNSGRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2183 - protein, 459 aa, Artificial Sequence
  chemically synthesized
QMQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDKNVRKHDYGDHPYGGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2184 - protein, 448 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVAGATSLWYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2185 - protein, 451 aa, Artificial Sequence
  chemically synthesized
QVQLQQSGPGLVKPSQSLSLTCAISGDSVSSNSAAWNWIRQSPSRGLEWLGRTYYRSKWYNDYAVSVKSRITIKPDTSKNQFSLQLNSVTPEDTAVYYCTRLANSDGVDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2186 - protein, 450 aa, Artificial Sequence
  chemically synthesized
QVQLQQSGPGLVKPSQTLSLTCAISGDSVSSDSAVWTWIRQSPSRGLEWLGRTYYKSKWYNDYAASVKSRITINPDTSKNQFSLHLNSVTPEDTAVYYCARGVTRTFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2187 - protein, 449 aa, Artificial Sequence
  chemically synthesized
QLQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAEGNGPFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2188 - protein, 450 aa, Artificial Sequence
  chemically synthesized
QITLKESGGGVVQPGRSLRLSCVASGFTFSTYPMHWVRQAPGKGLEWVAVISYDGRNEYYADSVKGRFTISRDNSKNTLYLQMNSLRAEDTAVYYCATRDTPLVGVSIYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2189 - protein, 451 aa, Artificial Sequence
  chemically synthesized
QMQLVQSGGGLVKAGGSLRLSCSASGFTFSSYAMHWVRQAPGKGLEYVSAISSNGGSTYYADSVKGRFTISRDNSKNTLYLQMSSLRAEDTAVYYCVNRAGYGDYRHFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2190 - protein, 449 aa, Artificial Sequence
  chemically synthesized
EVQLVQSGGGVVQPGGSLRLSCAASGFTFSSYGMHWVRQAPGKGLEWVAFISYDGSNKYYADSVKGRFTISRDNSKNTLYLQMNSLRAEDTAVYYCATTGDRFQEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2191 - protein, 452 aa, Artificial Sequence
  chemically synthesized
QMQLVQSGGVLLQPGRSLRLSCTASGFTFAAYNINWFRQGPGGGLEWVGFIRANADSGTTEYAASVKGRFFISRDDSRSTAYLQMTSLKTEDTAVYYCARDDRGRGDDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2192 - protein, 451 aa, Artificial Sequence
  chemically synthesized
QVQLVQSGGGLVQPGGSLRLSCAASGFTFSSYGMTWVRQAPGKGLEWVSTISGNGVGTYYPDSVKDRFTISRDSSKNTVYLQMNSLRAEDTAVYYCVKHGRAGINWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2193 - protein, 451 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGGLWAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2194 - protein, 447 aa, Artificial Sequence
  chemically synthesized
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKIGSCPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2195 - protein, 451 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPDSSSQCFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2196 - protein, 449 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2197 - protein, 452 aa, Artificial Sequence
  chemically synthesized
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDVNPELLGAGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2198 - protein, 453 aa, Artificial Sequence
  chemically synthesized
QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2199 - protein, 453 aa, Artificial Sequence
  chemically synthesized
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVKAPRGVVPAAMRGGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2200 - protein, 454 aa, Artificial Sequence
  chemically synthesized
QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2201 - protein, 459 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRSLPYRGLAPRSFGGYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2202 - protein, 451 aa, Artificial Sequence
  chemically synthesized
QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2203 - protein, 454 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGMYYYGSGSSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2204 - protein, 451 aa, Artificial Sequence
  chemically synthesized
QVQLVQSGGGLVQPGGSLRLSCAASGFTFSSYAMSWVRQAPGKGLEWVSGISGSGGSTYYADSVKGRFTISRDNSKNMLFLQMNSPRAEDTAVYYCAKKIAAAGKQPVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2205 - protein, 461 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRKVYDYVWGSYRLPGSVSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2206 - protein, 449 aa, Artificial Sequence
  chemically synthesized
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPGRAARPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2207 - protein, 455 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGAVAGTKPKYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2208 - protein, 453 aa, Artificial Sequence
  chemically synthesized
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARATYYYDSSGYRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2209 - protein, 446 aa, Artificial Sequence
  chemically synthesized
EVQLVQSGGGLVEPGGSLRLSCAASRFTFSDAWMSWVRQAPGKGLEWVGRIKSKISGGTTDYAAPVQGRFTISRDDSKNTLYLQMDSLKTEDTAVYYCANRNLGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2210 - protein, 457 aa, Artificial Sequence
  chemically synthesized
EVQLVQSGAEVKKPGASVKVSCKASGYTFTSYAMHWVRQAPGQRLEWMGWINAGNGNTKYSQKFQGRVTMTTDTSTSTAYMELRSLRSDDTAVYYCARARYYDSSGYIAPSGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2211 - protein, 452 aa, Artificial Sequence
  chemically synthesized
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGPAVDGAEYFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2212 - protein, 453 aa, Artificial Sequence
  chemically synthesized
QLQLQESGPGLVKPSQTLSLTCAISGDSVSSNSAAWNWIRQSPSRGLEWLGRTYYRSKWYNDYAVSLKSRITINPDTSKNQFSLQLNSVTPEDTAVYYCASLASGSPPPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2213 - protein, 449 aa, Artificial Sequence
  chemically synthesized
QVTLKESGGGVVQPGRSLRLSCAASGFTFSTYGMHWVRQAPGKGLEWVALISYDGSKKYYANSVKGRFTISRDNSKNTLYLQMKSLRAEDTAMYYCAKGPIVGATMDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2214 - protein, 448 aa, Artificial Sequence
  chemically synthesized
EVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARWYGDYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2215 - protein, 458 aa, Artificial Sequence
  chemically synthesized
EVQLVQSGAEVKKPGASVKVSCKASGYTFTSYAMHWVRQAPGQRLAWMGWINAGNGNTKYSEKFEGRVTITRDTSASTAYMELSSLRSEDTAVYYCARVAKYYYESGGYRASNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2216 - protein, 457 aa, Artificial Sequence
  chemically synthesized
QVQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAPPPTVGWYAPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2217 - protein, 450 aa, Artificial Sequence
  chemically synthesized
QLQLQESGGGLVQPGGSLRLSCSASGISFRDYWMHWIRQTPGKGLVWVSRINPDGSSTSYADSVKGRFTISRDNSKNTLYLQMNSLRAEDTAVYYCAKVTGRRVGAHDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2218 - protein, 451 aa, Artificial Sequence
  chemically synthesized
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAFAQPGAETLNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2219 - protein, 450 aa, Artificial Sequence
  chemically synthesized
QVQLQQSGPGLVKPSQTLSLTCAISGDSVSSKSAAWNWIRQSPSRGLEWLGRTYYRSKWNNDYALSVKSRITINPDTSKNQFSLQLKSVTPEDTALYYCVRQVAGGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2220 - protein, 453 aa, Artificial Sequence
  chemically synthesized
QVQLVQSGGGLVQPGRSLRLSCTASGFTFGDYAMSWFRQAPGKGLEWVSAISGSGGSTYYADSVKGRFTISRDNSKNTLYLQMNSLRAEDTAVYYCAKGSVYSGSYYMLIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2221 - protein, 455 aa, Artificial Sequence
  chemically synthesized
QVQLQQSGPGLVRPSQTLSLTCVISGDSVSSGSAAWNWIRQSPSRGLEWLGRTYYRAKWYNEYAGSVKSRITISPDTSKNQFSLQLNSVTPEDTAVYFCTRQDKDNTRYSGLGVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2222 - protein, 453 aa, Artificial Sequence
  chemically synthesized
EVQLVETGGGLVQPGGSLRLSCAASEFTLRNYGVSWVRQAPGKGLEWVSGMSGSGYSTYYADSVKGRFTISRDSSKNTLFLQMDSLRAEDTAIYYCARGPRMWSSGIDAFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2223 - protein, 446 aa, Artificial Sequence
  chemically synthesized
QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2224 - protein, 452 aa, Artificial Sequence
  chemically synthesized
QVQLQQSGPGLLKPSQTLSLTCAISGDSVSSNTATWNWIRQSPSRGLEWLGRTYYRSKWYKDNALSVKSRITINPDTSKNQFSLQLNSVTPEDTAVYYCAGGRAGIAAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2225 - protein, 450 aa, Artificial Sequence
  chemically synthesized
QVQLVQSGGGLIQPGGSLRLSCAASGFTVSSNYMSWVRQAPGKGLEWVSLIYSDGRTNYADSVKGRFTISRDNSKNTLYLQMNSLRAEDTAVYYCAKGALQGEWRRFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2226 - protein, 456 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCTRTNQGYGGNSGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2227 - protein, 450 aa, Artificial Sequence
  chemically synthesized
QVQLQQSGPGLVKPSQTLSLTCAISGDSVSGNSAAWNWIRQSPSRGLEWLGRTYYRSKWYNDYAVSVKSRITINPDTSKNQFSLQLNSVTPEDTAVYYCARIVGGAVDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2228 - protein, 454 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVRVGATTVYDSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2229 - protein, 459 aa, Artificial Sequence
  chemically synthesized
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGGSSPYYDSSGLLPWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2230 - protein, 449 aa, Artificial Sequence
  chemically synthesized
QVQLQESGGGLVQPGGSLRLSCAASGFTFSSYAMHWVRQAPGKGLEYVSAISSNGGSTYYANSVKGRFTISRDNSKNTLYLQMGSLRAEDMAVYYCARAKFWTYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2231 - protein, 452 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGGSGSYYKRFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2232 - protein, 457 aa, Artificial Sequence
  chemically synthesized
EVQLVQSGAEVRKPGASVKVSCKASGYTFTSYAISWVRQAPGQGLEWMGWISAYDGNTNYAQKLQGRVTMTTDTSTSTAYMEVRSLRSDDTAVYYCARDGTVRRVVGATTPGNFDYRGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2233 - protein, 454 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDLNRGYCSGGSCFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2234 - protein, 450 aa, Artificial Sequence
  chemically synthesized
QVQLQESGGGLVQPGGSLRLSCAASGFTFSSYAMSWVRQAPGKGLEWVSYISSSGTTIYYADSVKGRFTVSRDNAKNSLYLQMNSLRAEDTAVYYCARDYSSSGECFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2235 - protein, 450 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDQAAMVGYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2236 - protein, 453 aa, Artificial Sequence
  chemically synthesized
QVTLKESGGGVVQPGRSLRLSCAASGFIFSNYAIHWVRQAPGKGLEWVAVISYDGSNKYYADSVKGRFTISRDNSKNTLYLQMNSLRAEDTAVYYCARTFAGYSSKLGYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2237 - DNA, 1362 bp, Artificial Sequence
  chemically synthesized
gaagtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggctccttgtcccgaagtggctggtacgccggactctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2238 - DNA, 1362 bp, Artificial Sequence
  chemically synthesized
cagatcaccttgaaggagtctgggggaggcgtggtccagcctgggaggtccctgagactctcctgtgcagcctctggattcaccttcagtagttatagcatgaactgggtccgccaggctccaggcaaggggctgcagtgggtggcaattatatcagatgatggaagtaagagttactacgcagactccgtgcagggccgattcaccatctccagagacaattcgaggaacacagtatttctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2239 - DNA, 1359 bp, Artificial Sequence
  chemically synthesized
gaagtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggccgagggtatagcagcagtcggctctactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2240 - DNA, 1350 bp, Artificial Sequence
  chemically synthesized
caggtcaccttgaaggagtctgggggaggcttggtccggcctggagggtccctgagactctcctgtgaagcctctggattcaccttcagtgacccctacatggactgggtccgccaggctccaggcaaggggctggagtgggttggccgaattacaaataagcgtaccggttacgccacaacatatgccgcgtctgtgaaggacagattcaccatctcaagagatgattcaaggaagtcagtatatctgcaaatgaacagcctgaagaccgaggacacggccgtatattattgtgcaacagatgtcagtgggtccttcgcggcctacgggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2241 - DNA, 1347 bp, Artificial Sequence
  chemically synthesized
gaggtccagctggtacagtctgggggaggcgtggtccagcctgggaggtccctgagactctcctgtgcagcgtctggattcaccttcagtagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgggagagggcggagcagtggctggtactgtctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2242 - DNA, 1338 bp, Artificial Sequence
  chemically synthesized
caggtccagctggtgcagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacgagtatttctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2243 - DNA, 1359 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagtaaatccggggagttatacgagggaggtgagcaactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2244 - DNA, 1353 bp, Artificial Sequence
  chemically synthesized
caggtacagctgcagcagtcaggtccagaattggtgaagccctcgcagaccctcacactcacctgtggcatctccggggacagtgtctctagcaacagtgttacttggaactgggtcaggcagtccccatcgagaggccttgagtggctgggaaggacttactaccggtcccagtggtattataattatgcggtgtctgtgaaaagtcgaataaccatcagcccagacacatccaagaaccagttctccctgcagttgaattctgtgactcccgaggacacggctgtctattactgtgcaaccaggggacataactacggtgtagattactggggcccggggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2245 - DNA, 1350 bp, Artificial Sequence
  chemically synthesized
caggtgcagctggtgcagtctgggggaggcttggtaaagcctggggggtcccttagactctcctgtgcagcctctggattcactttcagtaacgcctggatgagctgggtccgccaggctccagggaaggggctggagtgggtttgccgtattaaaagcaaaactgatggtgagacaacagactacgctgcacccgtgaaaggcagattcaccatctcaagagatgattcaaaaaacacgctgtatctgcaaatgaacagcctgaaaactgaggacacagccgtgtatcactgtaccacaggggtgggatggtcgcccttccaatactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2246 - DNA, 1371 bp, Artificial Sequence
  chemically synthesized
gaggtccagctggtacagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacgacaaaatagcagcagctggattcacatactggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2247 - DNA, 1344 bp, Artificial Sequence
  chemically synthesized
caggtgcagctggtgcagtctggggctgaggtgaagaagcctggggcctcagtgaaggtctcctgcaaggcttctggatacaccttcgccgcctattatttacactgggtgcgacaggcccctggacaaggccttgagtggatggggcggatcagccctggtaacggtgtcacaagttatgcacagaaatttcagggcagagtcaccatgaccggggacacgtccattaacacagtctacatgcaactgaacaatttgatttctggcgacacggccgtatattactgtgcgagagaggctgccgacgacccgtttgaccattggggccagggagccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2248 - DNA, 1335 bp, Artificial Sequence
  chemically synthesized
gaagtgcagctggtgcagtctgggggaggcgtggtccagcctgggaggtccctgacactctcctgtgcagcctctggattcaccttcagttcccatcttatgcactgggtccgccaggctccaggcaaggggctggagtgggtggcagttatatcatatgatggaactagtaaatattacggagactccgtgaagggccgcttcaccatctccagagacaattccaagaacacgttgtatctgcaaatgaacagcctgcgagctgaagacacggctatatattactgtgcgaaagcagattataaatatgactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2249 - DNA, 1365 bp, Artificial Sequence
  chemically synthesized
gaggtgcagctggtgcagtctgggggaggcttggtcaagcctggagggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactactcatagacgcccaatttacgatattttgactggttttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2250 - DNA, 1353 bp, Artificial Sequence
  chemically synthesized
cagctgcagctgcaggagtccgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggatactatggttcggggagttattccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2251 - DNA, 1374 bp, Artificial Sequence
  chemically synthesized
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggctgtgtattactgtgcgagagatcggcgttactatgatagtagtggttattatcccgcctactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2252 - DNA, 1356 bp, Artificial Sequence
  chemically synthesized
gaagtgcagctggtgcagtctgggggaggcctggtcaagcctggggggtccctgagactctcctgtgcagcctctggattcaccttcagtagctatagcatgaactgggtccgccaggctccagggaaggggctggagtgggtttcatacattagtagtagtggtagttacacaaactacgcagactctgtgaagggccgattcaccatctccagagacaacgccaagaactcactgtatctgcaaataaacagcctgagagccgaggacacggccatttattactgtgcgagagacgggggctatgatagtagtggttttcactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2253 - DNA, 1377 bp, Artificial Sequence
  chemically synthesized
caggtacagctgcagcagtcaggtccaggactggtgaagccctcgcagaccctctcactcacctgtgccatctccggggacagtgtctctaacaacagggctgcttggaactggatcaggcagtcgccatcgagaggccttgagtggctgggaaggacatactacaggtccaagtggtataatgaatatgcagtctctgtgaaaagtcgaataaccatcaacccagacacatccaagaaccagttctccctgcagctgaactctatgactcccgaggactcggctgtgtattactgtgcaattttgcctagtagtggttatctacaggaccaccactactacggtatggacgtctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2254 - DNA, 1356 bp, Artificial Sequence
  chemically synthesized
gaggtgcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacacggccgtgtattactgtgcgagagccgcggtgggggatggatacagctatggtcggctcgattggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2255 - DNA, 1371 bp, Artificial Sequence
  chemically synthesized
gaggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccctcgtattactatgatagtagtggttactttacctggtacttcgatctctggggccgtggcaccctggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2256 - DNA, 1356 bp, Artificial Sequence
  chemically synthesized
gaggtccagctggtacagtctggagctgaggtgaagaagcctggggcctcagtgaaggtctcctgcaaggcttctggttacacctttaccagctatggtatcagctgggtgcgacaggcccctggacaagggcttgagtggatgggatggatcatccctatctttggtatagcaaactacgcacagaagttccagggcagagtcacgattaccgcggacaaatccacgagcacagcctacatggagctgagcagcctgagatctgaggacacggccgtgtattactgtgcgagagaactatacaactatggttcaaaggactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2257 - DNA, 1359 bp, Artificial Sequence
  chemically synthesized
gaagtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcggtacttgggatacagctatggttacgggctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2258 - DNA, 1362 bp, Artificial Sequence
  chemically synthesized
gaagtgcagctggtgcagtctggagcagaggtgaaaaagcccggggagtctctgaagatctcctgtaagggttctggatacagctttaccagctactggatcgcctgggtgcgccagatgcccgggaaaggcctggagtggatgggggtcatctatcctggtgactctgataccagatacagcccgtccttccaaggccaggtcaccatctcagccgacaagtccatcaataccgcctacctgcagtggagcagcctgaaggcctcggacaccgccatgtattactgtgcgagaccccattacgatattttgactggttcccgggcgccctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2259 - DNA, 1350 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccgagtggaatccaaggatgggtactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2260 - DNA, 1359 bp, Artificial Sequence
  chemically synthesized
gaggtgcagctggtggagtctgggggaggcgtggtccagcctgggaggtccctgagactctcctgtgcagcctctggattcactttcactgatgcctggatgaactgggtccgccaggctccagggaaggggctggagtggattggccgtgttaaaaacaaagctgatggtgagacaacggactacgctgcacccgtcaaaggcagaatcaccatctcaagagatgatgcaaagaacactctgtatgtgcaaatgaacagcctgaaaaccgaggacacagccgtgtattattgtaccgctgacctgcgactttctacgtgggatgcttatgatttctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2261 - DNA, 1341 bp, Artificial Sequence
  chemically synthesized
cagatcaccttgaaggagtctgggggaggcttggtccagcctggggggtccctaagactctcttgtacagtctcaggattcacctttagtaacaattggatgacctgggtccgccagactccagggaaggggctggagtgggtggccaacataaagcaagatggaactgagaaacactatgtggactctgtgaagggccgattcaccatctccagagacaacgccgagaactcactgtatctgcagatgaacagcctgagaggtgaggacacggccgtgtattattgtgcgagaaacagtcaacgttcgtttgactactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2262 - DNA, 1353 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttaggggatccccggggtggtattttgaactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2263 - DNA, 1365 bp, Artificial Sequence
  chemically synthesized
gaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcccggtcgagcccctggggggagttatcgttataccagggggcttttgatatctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2264 - DNA, 1353 bp, Artificial Sequence
  chemically synthesized
cagatcaccttgaaggagtctgggggaggcttggtacagcctggcaggtccctgagactctcctgtgcagcctctggattcacctttgatgattatgccatgcactgggtccggcaagctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataacgatttttggagtgggaaagtctttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2265 - DNA, 1353 bp, Artificial Sequence
  chemically synthesized
gaagtgcagctggtgcagtctgggggaggcttggtacagcctggggggtccctgagactctcctgtgcagcctctggattcaccttcagtagttatagcatgaactgggtccgccaggctccagggaaggggctggagtgggtttcatacatcagtagtactagtagtaccatatactacgcagactccgtgaagggccgattcaccatctccagagacaattccaagaatatgctgtttctacaaatgaacagcctgagagctgaggacacggctgtgtattactgtgcgaaagaagggggcagtggctggcgccactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2266 - DNA, 1359 bp, Artificial Sequence
  chemically synthesized
caggtcaccttgaaggagtctgggggaggcgtggtccagcctgggaggtccctgagactgtcctgtgcagcctctggattcaccttcagcagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagattattgtagtagtaccagctgccagaactggttcgacccctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2267 - DNA, 1347 bp, Artificial Sequence
  chemically synthesized
caggtccagctggtgcagtctgggggaggcttggtacagcctggggggtccctgagactctcctgtgcagcctctggattcacctttagcaactatgtcatgagctgggtccgccaggctccagggaaggggctggagtgggtctcagctattagtggtattggtgatactacatactacgcggactccgtgaagggccgattcaccatctccagagacaacgccaagaacacgctgtatctgcaaatgaacagtctgagagccgaggacacggctgtgtattactgtgcaagagggcgcgtggcgggggatgcttttgatatctggggccaagggacaatggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2268 - DNA, 1359 bp, Artificial Sequence
  chemically synthesized
cagctgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcaaggggcagcagctggtaccctggggtactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2269 - DNA, 1359 bp, Artificial Sequence
  chemically synthesized
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtacgagaggaatctatgatagtagtggttcttccaatccctttgactcctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2270 - DNA, 1362 bp, Artificial Sequence
  chemically synthesized
gaggtgcagctggtgcagtctggggctgaggtgaagaagcctggggcctcagtgaagatttcctgcgaggcttctggatacaccttcactgattatgctatacattgggtgcgccaggcccccggacaaagacttgagtggatgggatggatcaacgctggcgatggtggcacaaaaagttcacgggagttccagggcagagtcaccattaccagggacacatccgcgaccacagcctacatggaggtgagcagtctgagatctgaagacacggctgtctattactgtgcgagaggatattgtagtggtggtagctgcccaggaacggattttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2271 - DNA, 1356 bp, Artificial Sequence
  chemically synthesized
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatggtgtaggagggagagatggctacaattttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2272 - DNA, 1347 bp, Artificial Sequence
  chemically synthesized
gaagtgcagctggtgcagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagcccccctagcagcagatggctactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2273 - DNA, 1356 bp, Artificial Sequence
  chemically synthesized
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagcccgggggctacagtacctaatctggtacttcgatctctggggccgtggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2274 - DNA, 1359 bp, Artificial Sequence
  chemically synthesized
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagcccgggtatggttcggggagttattactgccccgcttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2275 - DNA, 1350 bp, Artificial Sequence
  chemically synthesized
gaggtccagctggtacagtctgggggaggcctggtcaagcctggggggtccctgagactctcctgtgcagcctctggattcaccttcagcagctatgctatcagctgggtgcgacaggcccctggacaagggcttgagtggatgggagggatcatccctatgtatggtacagcaaactacgcacagaagttccagggcagagtcacgattaccgcggacgaatccacgagcacagcctacatggaactgagcagcctgagatctgaggacacggccctctattactgtgcgagagaagctaagtggggaatgtactactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2276 - DNA, 1362 bp, Artificial Sequence
  chemically synthesized
gaggtgcagctggtggagtccgggggaggcgtggtccagcctgggaggtccctgagactctcctgtgcagcctctggattcaccttcagtagctatgctatacactgggtccgccaggctccaggcaaggggctggagtgggtggcaattatatcagatgatggaagtaagagttactacgcagactccgtgcagggccgattcaccatctccagagacaattcgaggaacacagtatatctgcaaatgaacagcctgagagctgaggacacggctatgtattactgtgcgagagacaggggaactaaatggaaccaattgaatgatgtttttgatatgtggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2277 - DNA, 1344 bp, Artificial Sequence
  chemically synthesized
cagatgcagctggtgcaatctggggctgaggtgaagaagcctggggcctcagtgaaggtctcctgcacggcttctggatacaccttcaccagttctgatatcaactgggtgcgacaggccactggacaagggcttgagtggatgggatggatgaaccctaacagtggtaacaccggctatgcagagaagttccagggcagggtcaccatgaccagcgactcctccataagcaccgcctacatggagttgagaagcctgaccactgaggacacggccgtatattactgtgcgagaggtgggggtgcgagctatactgactcctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2278 - DNA, 1368 bp, Artificial Sequence
  chemically synthesized
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtaccgctaaggggggctacgtcggatacagctatggaccttttgggggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2279 - DNA, 1359 bp, Artificial Sequence
  chemically synthesized
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggggggactatggttcggggtttcggatttaactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2280 - DNA, 1368 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccggcgggctatgatagggccgcttccgcgacttgtcgggtacttcgatctctggggccgtggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2281 - DNA, 1362 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccgccccgccccatcctgggttaaaacccgtaactggttcgacccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2282 - DNA, 1347 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggctagcagtggctggaactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2283 - DNA, 1362 bp, Artificial Sequence
  chemically synthesized
caggtgcagctgcaggagtccggtccaggactggtgaagccctcgcagaccctctcactcacctgtgccatctccggggacagtgtctctagcaacaatgctgcttggaactggatcaggcagtccccatcgagaggccttgagtggctgggaaggacattctacaggtccaagtggtataatgactatgcagtttctgtgaaaagtcgactaaccgtcaacccagacacatccaagaaccagttctccctgcggttgaactctgtgagtcccgaggacacggctgtgtattactgtgcaagagggggaagatataccaagggagggtactttgacgactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2284 - DNA, 1359 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagattggatagcagtggccgtggtggttactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2285 - DNA, 1371 bp, Artificial Sequence
  chemically synthesized
gaggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagagttggtgggtaccagctctccttattactactactactacggtatggacgtctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2286 - DNA, 1344 bp, Artificial Sequence
  chemically synthesized
cagctgcagctgcaggagtcggggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagactattactatggttcggggagttctccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2287 - DNA, 1365 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccggccatattgtagtagtaccagctgctacccagagtggttcgacccctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2288 - DNA, 1371 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaattaaggggtatagattactatgatagtagtggttaccaacgggggtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2289 - DNA, 1347 bp, Artificial Sequence
  chemically synthesized
caggtgcagctgcaggagtccggcccaggactggtgaagccttcggagaccctgtccctcacctgcactgtctctggtggctccatcagtagttactactggagctggatccggcagcccccagggaagggactggagtggattggctatatctattacactgggagcaccaactacaacccctccctcaagagccgagtcaccatatcagtagacacgtccaagaaccagttctccctgaagctgagctctgtgaccactgcggacacggccgtgtattactgtgcgagaggtgggaggggggatggggccgcttttgacatctggggccaagggacaatggtcaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2290 - DNA, 1359 bp, Artificial Sequence
  chemically synthesized
caggtgcagctggtgcaatctgggggaggcgtggtccagcctgggaggtccctgagactctcctgtgcagcgtctggattcaccttcagcagctctgccatgcactgggtccgccaggctccaggcaagggactggagtgggtggcaatgatttggcatgatgagagtaagaaatactatgcagactccgtgaagggccgattcactatctccagagacaattccaagaacacgctgtatctgcaaatgaacagcctgagagctgaggacacggctgtgtattactgtgcgagaccccccgacggtggtaactccggtcgctggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2291 - DNA, 1377 bp, Artificial Sequence
  chemically synthesized
cagatgcagctggtgcaatctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacaagaacgtccgaaaacatgactacggtgaccacccctacggggggtactttgactactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2292 - DNA, 1344 bp, Artificial Sequence
  chemically synthesized
gaggtccagctggtacagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagtggcgggagctacttccctatggtactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2293 - DNA, 1353 bp, Artificial Sequence
  chemically synthesized
caggtacagctgcagcagtcaggtccaggactggtgaagccctcgcagagcctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaagagtcgaataaccatcaaaccagacacatccaagaaccagttctccctgcagctgaactctgtgactcccgaggacacggctgtgtattactgtacaaggctagctaattccgacggtgtggacgtctggggccaagggacaatggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2294 - DNA, 1350 bp, Artificial Sequence
  chemically synthesized
caggtacagctgcagcagtcaggtccaggactggtgaagccctcgcagaccctctcactcacctgtgccatctccggggacagtgtctctagcgacagtgctgtttggacctggatcaggcagtccccatcgagaggccttgagtggctgggaaggacatactacaagtcgaagtggtataatgattatgcagcatctgtgaaaagtcgaataaccatcaacccagacacatccaagaaccagttctccctgcacctgaactctgtgactcccgaggacacggctgtgtattactgtgcaagaggtgtaacccggacctttgactactggggccaggggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2295 - DNA, 1347 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcagaaggcaatgggccgttcgacccctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2296 - DNA, 1350 bp, Artificial Sequence
  chemically synthesized
cagatcaccttgaaggagtctgggggaggcgtggtccagcctgggaggtccctgagactctcctgtgtagcctctggattcaccttcagtacctatcccatgcactgggtccgccaggctccaggcaaggggctggagtgggtggcagttatatcatatgatggacgtaatgaatactacgcagactccgtgaagggccgattcaccatctccagagacaattccaaaaacacgctgtatctgcaaatgaacagtctgcgagctgaagacacggctgtctattattgtgcgactcgggatacacctttggttggggtttcgatatactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2297 - DNA, 1353 bp, Artificial Sequence
  chemically synthesized
cagatgcagctggtgcaatctgggggaggcctggtcaaggctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaatcgggcgggttacggtgactacagacacttccagcactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2298 - DNA, 1347 bp, Artificial Sequence
  chemically synthesized
gaggtgcagctggtgcagtctgggggaggcgtggtccagcctggggggtccctgagactctcctgtgcagcgtctggattcaccttcagtagctatggcatgcactgggtccgccaggctccaggcaaggggctggagtgggtggcatttatatcatatgatggaagtaataaatactacgcagactccgtgaagggccgattcaccatctccagagacaattccaagaacacgctgtatctgcaaatgaacagcctgagagccgaggacacggccgtatattactgtgcgacaacaggggaccgcttccaagagtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2299 - DNA, 1356 bp, Artificial Sequence
  chemically synthesized
cagatgcagctggtgcagtctgggggagtcttgcttcagccagggcggtccctgagactctcctgtacagcttctggattcacctttgctgcttataatatcaactggttccgccagggtcctgggggggggctggagtgggtaggtttcattagagccaacgctgatagtgggacaacagagtacgccgcgtctgtgaaaggcagattcttcatctcaagagatgattccagaagcaccgcctacctgcaaatgactagccttaaaaccgaggacacagccgtttattactgtgccagagatgatcggggtcggggagatgactttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2300 - DNA, 1353 bp, Artificial Sequence
  chemically synthesized
caggtgcagctggtgcaatctgggggaggcttggtacagcctggggggtccctgagactctcctgtgcagcctctggattcacctttagcagctatggcatgacgtgggtccgccaggctccagggaaggggctggagtgggtctcaactattagtggtaatggtgttggcacatactacccagactccgtgaaggaccggttcaccatctccagagacagttccaagaacacggtgtatctgcaaatgaacagcctgagagccgaggacacggccgtatattactgtgtgaaacatggtagggccggaataaactggtacttcgatctctggggccgtggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2301 - DNA, 1353 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggggagggctttgggcttttgatatctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2302 - DNA, 1341 bp, Artificial Sequence
  chemically synthesized
gaggtccagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacaagatcggcagctgtccttactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2303 - DNA, 1353 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccggatagcagcagtcaatgttttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2304 - DNA, 1347 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaagcagtggctggtcactgcctgaagactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2305 - DNA, 1356 bp, Artificial Sequence
  chemically synthesized
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacggatgtgaacccggagctactgggggcgggatttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2306 - DNA, 1359 bp, Artificial Sequence
  chemically synthesized
caggtcaccttgaaggagtctgggggaggcttggtccagcctggagggtccctgagactctcctgtgcagcctctggattcaccttcagtgaccagtacatggactgggtccgccaggctccagggaaggggctggagtgggttggccgtgttagaaacaaagctaacagttacaccacagaatacgccgcgtctgtgaaaggcagattcaccatctcaagagatgattcaaagaactcactgtatctgcaaatgaatagtctgaacaccgaggacacggccatgtatttctgtgctagtagtctcaatagtgggggctaccgatgcttccatcactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2307 - DNA, 1359 bp, Artificial Sequence
  chemically synthesized
caggtccagctggtgcagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaaagcgccgaggggtgtagtaccagctgctatgcgggggggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2308 - DNA, 1362 bp, Artificial Sequence
  chemically synthesized
caggtgcagctgcaggagtcggggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattggtgggcaatagtgggagctactatccgtttgggtactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2309 - DNA, 1377 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctcggtgaccgccgcggacacggctgtgtattactgtgcgagaggccggtcccttccctaccgggggttggctcctagatctttcggaggatactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2310 - DNA, 1353 bp, Artificial Sequence
  chemically synthesized
caggtgcagctgcaggagtcggggggaggcttggtacggcctggagggtccctgagactctcctgtggagactctggattcaacttcagtggatatgaaatgaactgggtccgccaggctccagggaaggggctggagtgggtttcatacgtcagtactagtggtagtaccagatactacgcagactctgtgaagggccgatttaccatctccagagacaacgccaagaacaccctgtatttgcaaatgaacagtctgagagtcgaggacacggctgtgtattactgtgcaagaggacggactcactggggcccccaggactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2311 - DNA, 1362 bp, Artificial Sequence
  chemically synthesized
caggtgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggaggaatgtattactatggttcggggagctcgtactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2312 - DNA, 1353 bp, Artificial Sequence
  chemically synthesized
caggtgcagctggtgcaatctgggggaggcttggtacagcctggggggtccctgagactctcctgtgcagcctctggattcacctttagcagctatgccatgagctgggtccgccaggctccagggaaggggctggaatgggtctcaggtattagtggtagtggtggtagcacatactacgcagactccgtgaagggccggttcaccatctccagagacaattccaagaacatgctgtttctgcaaatgaacagcccgagagccgaggacacggccgtatattactgtgcgaagaaaatagcagcagctggtaagcaacctgttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2313 - DNA, 1383 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaggaaggtgtatgattacgtttgggggagttatcgcctccccgggtcggtatcgtactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2314 - DNA, 1347 bp, Artificial Sequence
  chemically synthesized
caggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccggggagagcagctcgtccagactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2315 - DNA, 1365 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggccccggggcagtggctggtactaagccaaagtactactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2316 - DNA, 1359 bp, Artificial Sequence
  chemically synthesized
gaggtccagctggtgcagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggccacgtattactatgatagtagtggttataggtttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2317 - DNA, 1338 bp, Artificial Sequence
  chemically synthesized
gaggtccagctggtacagtctgggggaggcttggtagaaccgggggggtcccttagactctcctgtgcagcctctcgattcactttcagtgacgcctggatgagctgggtccgccaggctccaggtaaggggctggagtgggttggccgtattaaaagcaaaataagtggtgggacaacagactacgctgcacccgtgcaaggcagattcaccatctcaagagatgattcaaaaaacacgctgtatctgcaaatggacagcctgaaaaccgaggacacagccgtgtattactgtgcgaaccgaaacttaggctactggggccagggcaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2318 - DNA, 1371 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccatgaccacagacacatccacgagcacagcctacatggagctgaggagcctgagatctgacgacacggccgtgtattactgtgcgagagctcgttactatgatagtagtggttatattgccccatcgggttactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2319 - DNA, 1356 bp, Artificial Sequence
  chemically synthesized
caggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatggccccgccgttgatggtgctgaatacttccagcactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2320 - DNA, 1359 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgcgaggccttgagtggctgggaaggacttactacaggtccaagtggtataatgattatgcagtatctctgaaaagtcgaataaccatcaacccggacacatccaagaaccagttctccctgcagctgaactctgtgactcccgaggacacggctgtatattactgtgcaagtttggcgagtggttccccccctccgggggactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2321 - DNA, 1347 bp, Artificial Sequence
  chemically synthesized
caggtcaccttgaaggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaaaaaatactatgcaaactccgtgaagggccgattcaccatctccagagacaattccaagaacacgttgtatctgcaaatgaaaagtctgagagctgaggacacggctatgtattactgtgcgaaaggccctatagtgggagcgactatggactactggggccagggagccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2322 - DNA, 1344 bp, Artificial Sequence
  chemically synthesized
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatggtacggtgactacggccttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2323 - DNA, 1374 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgcgtggatgggatggatcaacgctggcaatggtaacacaaaatattcagagaagttcgaaggcagagtcaccatcaccagggacacatccgcgagcacagcctacatggagctgagcagcctgagatctgaagacacggctgtgtattactgtgcgagggtcgccaaatattattacgagagtggtggttatcgggcctccaactggttcgacccctggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2324 - DNA, 1371 bp, Artificial Sequence
  chemically synthesized
caggtgcagctgcaggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagcgccccctccgactgttggctggtacgcccccgtctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2325 - DNA, 1350 bp, Artificial Sequence
  chemically synthesized
cagctgcagctgcaggagtccgggggaggcttagttcagccgggggggtccctgagactctcctgctcagcctctggaatcagcttcagagattactggatgcactggatccgccaaactccagggaaggggctggtgtgggtctcacgtattaatcctgatgggagtagcacaagctacgcggactccgtgaagggccgattcaccatctccagagacaattccaagaacacgctgtatctgcaaatgaacagcctgagagctgaggacacggctgtgtattactgtgcgaaagttacgggacggagagtgggagcccatgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2326 - DNA, 1353 bp, Artificial Sequence
  chemically synthesized
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcctttgcccagccgggcgctgagacgttgaacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2327 - DNA, 1350 bp, Artificial Sequence
  chemically synthesized
caggtacagctgcagcagtcaggtccaggactggtgaagccctcgcagaccctctcactcacctgtgccatctccggggacagtgtctctagcaaaagtgctgcttggaactggatcaggcagtccccatcgagaggccttgagtggctgggaaggacatactacaggtccaaatggaataatgattatgcattatctgtgaaaagtcgaataaccatcaacccagacacatccaagaaccagttctccctgcagctgaagtctgtgactcccgaggacacggctctgtattactgtgtaagacaagtcgcgggcggtatggacgtctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2328 - DNA, 1359 bp, Artificial Sequence
  chemically synthesized
caggtgcagctggtgcaatctgggggaggcttggtacagccagggcggtccctgagactctcctgtacagcttctggattcacctttggtgattatgctatgagctggttccgccaggctccagggaaggggctggagtgggtctcagctattagtggtagtggtggtagcacatactatgcagactccgtgaagggccgattcaccatctccagagacaattccaagaacacgctgtatctgcaaatgaacagcctgagagctgaggacacggctgtgtattactgtgcgaaaggatcggtatatagtgggagctactatatgctcattgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2329 - DNA, 1365 bp, Artificial Sequence
  chemically synthesized
caggtacagctgcagcagtcaggtccaggactggtgaggccctcgcagaccctctcactcacctgtgtcatctccggggacagtgtctctagcggcagtgctgcttggaactggatcaggcagtccccatcgagaggccttgagtggctgggaaggacatattatagggccaagtggtataatgaatatgcagggtctgtgaaaagccgaataaccatcagtccggacacatccaagaaccagttctccctgcaactgaactctgtgactcccgaggacacggctgtgtatttctgtacaagacaagacaaagacaacacgagatattccggtttgggcgtctggggccaagggaccacggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2330 - DNA, 1359 bp, Artificial Sequence
  chemically synthesized
gaggtgcagctggtggagaccgggggaggcttagttcagcctggggggtccctgagactctcctgtgcagcctctgaattcacccttaggaactatggcgtgagctgggtccgccaggctccagggaaggggctggagtgggtctcaggtatgagtggtagtggttatagtacatactacgcagactccgtgaagggccggttcaccatctccagagacagttccaagaacacgctgtttctgcaaatggacagcctgagagccgaggacacggccatatattactgtgcgagagggccccgaatgtggagcagtggcattgatgcttttgatatctggggccacgggacaatggtgaccgtctcttcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2331 - DNA, 1338 bp, Artificial Sequence
  chemically synthesized
caggtgcagctacagcagtggggcgcaggactgttgaagccttcggagaccctgtccctcacctgcgctgtctatggtgggtccgtcagtggttactactggagctggatccgccagcccccagggaaggggctggagtggatgggggaaatccatcatagtggaagcaccaactacaacccgtccctcaagagtcgagtcaccatatcactagacacgcccaagaaccagttctccctgaagctaagctctgtgaccgccgcggacacggctgtatattactgtgcgagacgggattgggcaggaaaaagggtctggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2332 - DNA, 1356 bp, Artificial Sequence
  chemically synthesized
caggtacagctgcagcagtcaggtccaggactattaaagccctcgcagaccctctcactcacctgtgccatctccggggacagtgtctctagcaacactgctacttggaactggatcaggcagtccccatcgagaggccttgagtggctgggaaggacatactacaggtccaagtggtataaggataatgcactgtctgtgaaaagtcgaataaccatcaacccagacacatccaagaaccagttctccctgcagctgaactctgtgactcccgaggacacggctgtgtattactgtgcaggaggtcgggctggtattgccgcttttgatatctggggccaagggaccacggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2333 - DNA, 1350 bp, Artificial Sequence
  chemically synthesized
caggtgcagctggtgcaatctggaggaggcttgatccagcctggggggtccctgagactctcctgtgcagcctctgggttcaccgtcagtagcaactacatgagctgggtccgccaggctccagggaaggggctggaatgggtctcacttatttatagtgatggtcgcacaaactatgcagactccgtgaagggccgattcaccatctccagagacaattccaagaacacgctgtatctgcaaatgaacagcctgagagccgaggacacggccgtatattactgtgcgaagggggccctacagggcgaatggcggagatttgactactggggccagggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2334 - DNA, 1368 bp, Artificial Sequence
  chemically synthesized
caggtgcagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataatgattatgcagtatctgtgaaaagtcgaataaccatcaacccagacacatccaagaaccagttctccctgcagctgaactctgtgactcccgaggacacggctgtgtattactgtacaagaaccaaccagggatacggtggtaactccggggtatttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2335 - DNA, 1350 bp, Artificial Sequence
  chemically synthesized
caggtgcagctacagcagtcaggtccaggactggtgaagccctcgcagaccctctcactcacctgtgccatctccggggacagtgtctctggcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagttgaattctgtgactcccgaggacacggctgtgtattactgtgcgaggatagtgggaggtgccgttgactgctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2336 - DNA, 1362 bp, Artificial Sequence
  chemically synthesized
gaggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagttagagtgggagctactactgtttacgacagctggttcgacccctggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2337 - DNA, 1377 bp, Artificial Sequence
  chemically synthesized
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggggggtccagcccatactatgatagtagtggtttactaccctggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2338 - DNA, 1347 bp, Artificial Sequence
  chemically synthesized
caggtgcagctgcaggagtcggggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagctaagttttggacatactactttgactactggggccagggaaccctggtgaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2339 - DNA, 1356 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcggtggttcggggagttattataagaggttctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2340 - DNA, 1371 bp, Artificial Sequence
  chemically synthesized
gaggtgcagctggtgcagtctggagctgaggtgaggaagcctggggcctcagtgaaggtctcctgcaaggcttctggttacacatttaccagttatgccatcagctgggtgcgacaggcccctggacaagggcttgagtggatggggtggatcagcgcttacgacggtaacacaaactatgcacagaagctccagggcagagtcaccatgaccacagacacatccacgagcacagcctacatggaggtgaggagcctgagatctgacgacacggccgtgtattactgtgcgagagatggtacggtccgaagggtagtgggagctactacccctggaaactttgactacaggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2341 - DNA, 1362 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgaatcgaggatattgtagtggtggtagctgctttggctactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2342 - DNA, 1350 bp, Artificial Sequence
  chemically synthesized
caggtgcagctgcaggagtctgggggaggcttggtacagccgggggggtccctgagactctcctgtgcagcctctggattcacctttagcagctatgccatgagctgggtccgccaggctccagggaaggggctggagtgggtttcatacattagtagtagtggtactaccatatactacgcagactctgtgaagggccgattcaccgtctccagagacaatgccaagaactcactgtatctgcaaatgaacagcctgagagccgaggacacggccgtgtattactgtgcgagggattatagcagctcgggggagtgctttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2343 - DNA, 1350 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcaggcagctatggtaggctactttgactactggggccagggaaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2344 - DNA, 1359 bp, Artificial Sequence
  chemically synthesized
caggtcaccttgaaggagtctgggggaggcgtggtccagcctgggaggtccctgagactctcctgtgcagcctctggattcatcttcagtaactatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggacttttgcggggtatagcagcaaactggggtacttcgatctctggggccgtggcaccctggtcaccgtctcctcagcatccaccaaggggccttccgtgttccccctggccccttcatccaagtcgacctctggtggaaccgccgcactcggttgcctggtcaaagactacttccccgagcccgtgactgtctcgtggaactcgggcgccctcacatccggagtgcatacctttcccgccgtgttgcagtccagcggcctgtacagcctgagctccgtcgtgacagtgccgtcctcctcccttggaacccagacctatatctgcaacgtcaatcacaagccctccaacaccaaagtggacaagaaggtcgaacccaagtcctgcgacaagactcacacctgtccgccttgtccagcccctgagctgctgggtggtccgtccgtgttcctcttcccgcccaagccgaaggacactctgatgatttcacgcaccccggaagtcacttgcgtggtcgtggacgtgtcgcacgaagatcccgaagtgaaattcaattggtacgtggatggggtcgaagtgcacaacgccaagaccaagcctagggaagaacagtacgcctctacgtaccgggtggtgtccgtgctgaccgtgctgcaccaggactggctgaacggaaaggagtacaagtgcaaagtgtcaaacaaggctctccctgcccctatcgaaaagaccatcagcaaggccaagggtcaacctagggagccccaggtctacactttgccgcctagccgggaagaaatgactaagaaccaagtgtccctgacttgccttgtcaagggcttttatccgtccgacatcgccgtggagtgggagtccaacggacaaccggagaacaactacaagaccaccccaccggtgctcgattccgatggctccttcttcctgtactccaagctgactgtggacaagtcaagatggcagcagggaaacgtgttctcctgctccgtgatgcacgaagcgctgcacaaccattacacccagaaatcactgtcactttcgccgggaaaa

SEQ ID NO: 2345 - protein, 450 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARGSLSRSGWYAGLFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2346 - protein, 450 aa, Artificial Sequence
  chemically synthesized
QITLKESGGGVVQPGRSLRLSCAASGFTFSSYSMNWVRQAPGKGLQWVAIISDDGSKSYYADSVQGRFTISRDNSRNTVFLQMNSLRAEDTAMYYCARDRGTKWNQLNDVFDMWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2347 - protein, 449 aa, Artificial Sequence
  chemically synthesized
EVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARGRGYSSSRLYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2348 - protein, 446 aa, Artificial Sequence
  chemically synthesized
QVTLKESGGGLVRPGGSLRLSCEASGFTFSDPYMDWVRQAPGKGLEWVGRITNKRTGYATTYAASVKDRFTISRDDSRKSVYLQMNSLKTEDTAVYYCATDVSGSFAAYGGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2349 - protein, 445 aa, Artificial Sequence
  chemically synthesized
EVQLVQSGGGVVQPGRSLRLSCAASGFTFSSYAMHWVRQAPGQRLEWMGWINAGNGNTKYSQKFQGRVTITRDTSASTAYMELSSLRSEDTAVYYCAGEGGAVAGTVYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2350 - protein, 442 aa, Artificial Sequence
  chemically synthesized
QVQLVQSGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDEYFYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2351 - protein, 449 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVNPGSYTREVSNFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2352 - protein, 447 aa, Artificial Sequence
  chemically synthesized
QVQLQQSGPELVKPSQTLTLTCGISGDSVSSNSVTWNWVRQSPSRGLEWLGRTYYRSQWYYNYAVSVKSRITISPDTSKNQFSLQLNSVTPEDTAVYYCATRGHNYGVDYWGPGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2353 - protein, 446 aa, Artificial Sequence
  chemically synthesized
QVQLVQSGGGLVKPGGSLRLSCAASGFTFSNAWMSWVRQAPGKGLEWVCRIKSKTDGETTDYAAPVKGRFTISRDDSKNTLYLQMNSLKTEDTAVYHCTTGVGWSPFQYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2354 - protein, 453 aa, Artificial Sequence
  chemically synthesized
EVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRDDKIAAAGFTYWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2355 - protein, 444 aa, Artificial Sequence
  chemically synthesized
QVQLVQSGAEVKKPGASVKVSCKASGYTFAAYYLHWVRQAPGQGLEWMGRISPGNGVTSYAQKFQGRVTMTGDTSINTVYMQLNNLISGDTAVYYCAREAADDPFDHWGQGALVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2356 - protein, 441 aa, Artificial Sequence
  chemically synthesized
EVQLVQSGGGVVQPGRSLTLSCAASGFTFSSHLMHWVRQAPGKGLEWVAVISYDGTSKYYGDSVKGRFTISRDNSKNTLYLQMNSLRAEDTAIYYCAKADYKYDWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2357 - protein, 451 aa, Artificial Sequence
  chemically synthesized
EVQLVQSGGGLVKPGGSLRLSCTASGFTFGDYAMSWVRQAPGKGLEWVGFIRSKAYGGTTEYAASVKGRFTISRDDSKSIAYLQMNSLKTEDTAVYYCTTHRRPIYDILTGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2358 - protein, 447 aa, Artificial Sequence
  chemically synthesized
QLQLQESGGGLVQPGRSLRLSCTASGFTFGDYAMSWVRQAPGKGLEWVGFIRSKAYGGTTEYAASVKGRFTISRDDSKSIAYLQMNSLKTEDTAVYYCTREDTMVRGVIPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2359 - protein, 454 aa, Artificial Sequence
  chemically synthesized
QLQLQESGSGLVKPSQTLSLTCAVSGGSISSGGYSWSWIRQPPGKGLEWIGYIYHSGSTYYNPSLKSRVTISVDRSKNQFSLKLSSVTAADTAVYYCARDRRYYDSSGYYPAYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2360 - protein, 448 aa, Artificial Sequence
  chemically synthesized
EVQLVQSGGGLVKPGGSLRLSCAASGFTFSSYSMNWVRQAPGKGLEWVSYISSSGSYTNYADSVKGRFTISRDNAKNSLYLQINSLRAEDTAIYYCARDGGYDSSGFHFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2361 - protein, 455 aa, Artificial Sequence
  chemically synthesized
QVQLQQSGPGLVKPSQTLSLTCAISGDSVSNNRAAWNWIRQSPSRGLEWLGRTYYRSKWYNEYAVSVKSRITINPDTSKNQFSLQLNSMTPEDSAVYYCAILPSSGYLQDHHYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2362 - protein, 448 aa, Artificial Sequence
  chemically synthesized
EVQLVQSGAEVKKPGASVKVSCKASGYTFTSYGISWVRQAPGQGLEWMGWISAYNGNTNYAQKLQGRVTMTTDTSTSTAYMELSSLRSEDTAVYYCARAAVGDGYSYGRLDWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2363 - protein, 453 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPSYYYDSSGYFTWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2364 - protein, 448 aa, Artificial Sequence
  chemically synthesized
EVQLVQSGAEVKKPGASVKVSCKASGYTFTSYGISWVRQAPGQGLEWMGWIIPIFGIANYAQKFQGRVTITADKSTSTAYMELSSLRSEDTAVYYCARELYNYGSKDYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2365 - protein, 449 aa, Artificial Sequence
  chemically synthesized
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARGGTWDTAMVTGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2366 - protein, 450 aa, Artificial Sequence
  chemically synthesized
EVQLVQSGAEVKKPGESLKISCKGSGYSFTSYWIAWVRQMPGKGLEWMGVIYPGDSDTRYSPSFQGQVTISADKSINTAYLQWSSLKASDTAMYYCARPHYDILTGSRAPFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2367 - protein, 446 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARVESKDGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2368 - protein, 449 aa, Artificial Sequence
  chemically synthesized
EVQLVESGGGVVQPGRSLRLSCAASGFTFTDAWMNWVRQAPGKGLEWIGRVKNKADGETTDYAAPVKGRITISRDDAKNTLYVQMNSLKTEDTAVYYCTADLRLSTWDAYDFWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2369 - protein, 443 aa, Artificial Sequence
  chemically synthesized
QITLKESGGGLVQPGGSLRLSCTVSGFTFSNNWMTWVRQTPGKGLEWVANIKQDGTEKHYVDSVKGRFTISRDNAENSLYLQMNSLRGEDTAVYYCARNSQRSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2370 - protein, 447 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGDPRGGILNYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2371 - protein, 451 aa, Artificial Sequence
  chemically synthesized
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARSSPWGELSLYQGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2372 - protein, 447 aa, Artificial Sequence
  chemically synthesized
QITLKESGGGLVQPGRSLRLSCAASGFTFDDYAMHWVRQAPGKGLEWVSAISGSGGSTYYADSVKGRFTISRDNSKNTLYLQMNSLRAEDTAVYYCAKDNDFWSGKVFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2373 - protein, 447 aa, Artificial Sequence
  chemically synthesized
EVQLVQSGGGLVQPGGSLRLSCAASGFTFSSYSMNWVRQAPGKGLEWVSYISSTSSTIYYADSVKGRFTISRDNSKNMLFLQMNSLRAEDTAVYYCAKEGGSGWRHYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2374 - protein, 449 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARDYCSSTSCQNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2375 - protein, 445 aa, Artificial Sequence
  chemically synthesized
QVQLVQSGGGLVQPGGSLRLSCAASGFTFSNYVMSWVRQAPGKGLEWVSAISGIGDTTYYADSVKGRFTISRDNAKNTLYLQMNSLRAEDTAVYYCARGRVAGDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2376 - protein, 449 aa, Artificial Sequence
  chemically synthesized
QLQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQGAAAGTLGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2377 - protein, 449 aa, Artificial Sequence
  chemically synthesized
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCTRGIYDSSGSSNPFDSWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2378 - protein, 450 aa, Artificial Sequence
  chemically synthesized
EVQLVQSGAEVKKPGASVKISCEASGYTFTDYAIHWVRQAPGQRLEWMGWINAGDGGTKSSREFQGRVTITRDTSATTAYMEVSSLRSEDTAVYYCARGYCSGGSCPGTDFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2379 - protein, 448 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDGVGGRDGYNFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2380 - protein, 445 aa, Artificial Sequence
  chemically synthesized
EVQLVQSGGGLVQPGGSLRLSCAASGFTVSSNYMSWVRQAPGKGLEWVSVIYSGGSTYYADSVKGRFTISRDNSKNTLYLQMNSLRAEDTAVYYCARAPLAADGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2381 - protein, 448 aa, Artificial Sequence
  chemically synthesized
EVQLVQSGAEVKKPGSSVKVSCKASGGTFSSYAISWVRQAPGQGLEWMGGIIPIFGTANYAQKFQGRVTITADESTSTAYMELSSLRSEDTAVYYCARARGLQYLIWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2382 - protein, 449 aa, Artificial Sequence
  chemically synthesized
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCASPGMVRGVITAPLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2383 - protein, 446 aa, Artificial Sequence
  chemically synthesized
EVQLVQSGGGLVKPGGSLRLSCAASGFTFSSYAISWVRQAPGQGLEWMGGIIPMYGTANYAQKFQGRVTITADESTSTAYMELSSLRSEDTALYYCAREAKWGMYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2384 - protein, 450 aa, Artificial Sequence
  chemically synthesized
EVQLVESGGGVVQPGRSLRLSCAASGFTFSSYAIHWVRQAPGKGLEWVAIISDDGSKSYYADSVQGRFTISRDNSRNTVYLQMNSLRAEDTAMYYCARDRGTKWNQLNDVFDMWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2385 - protein, 444 aa, Artificial Sequence
  chemically synthesized
QMQLVQSGAEVKKPGASVKVSCTASGYTFTSSDINWVRQATGQGLEWMGWMNPNSGNTGYAEKFQGRVTMTSDSSISTAYMELRSLTTEDTAVYYCARGGGASYTDSWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2386 - protein, 452 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTAKGGYVGYSYGPFGGYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2387 - protein, 449 aa, Artificial Sequence
  chemically synthesized
QVQLVQSGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRGGTMVRGFGFNYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2388 - protein, 452 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARARRAMIGPLPRLVGYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2389 - protein, 450 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPAPSWVKTRNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2390 - protein, 445 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAREASSGWNWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2391 - protein, 450 aa, Artificial Sequence
  chemically synthesized
QVQLQESGPGLVKPSQTLSLTCAISGDSVSSNNAAWNWIRQSPSRGLEWLGRTFYRSKWYNDYAVSVKSRLTVNPDTSKNQFSLRLNSVSPEDTAVYYCARGGRYTKGGYFDDWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2392 - protein, 449 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRLDSSGRGGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2393 - protein, 453 aa, Artificial Sequence
  chemically synthesized
EVQLVESGGGVVQPGRSLRLSCTASGFTFSSYGMHWVRQAPGKGLEWVAVISYDGSNKYYADSVKGRFTISRDNSKNTLYLQMNSLRAEDTAVYYCAKELVGTSSPYYYYYYGMDVWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2394 - protein, 444 aa, Artificial Sequence
  chemically synthesized
QLQLQESGGGLVQPGGSLRLSCAASGFTVSSNYMSWVRQAPGKGLEWVSVIYSGGSTYYADSVKGRFTISRDNSKNTLYLQMNSLRAEDTAVYYCARDYYYGSGSSPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2395 - protein, 451 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRPYCSSTSCYPEWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2396 - protein, 453 aa, Artificial Sequence
  chemically synthesized
QVTLKESGGGVVQPGRSLRLSCAASGFTFSSYGMHWVRQAPGKGLEWVAVISYDGSNKYYADSVKGRFTISRDNSKNTLYLQMNSLRAEDTAVYYCAKLRGIDYYDSSGYQRGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2397 - protein, 445 aa, Artificial Sequence
  chemically synthesized
QVQLQESGPGLVKPSETLSLTCTVSGGSISSYYWSWIRQPPGKGLEWIGYIYYTGSTNYNPSLKSRVTISVDTSKNQFSLKLSSVTTADTAVYYCARGGRGDGAAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2398 - protein, 449 aa, Artificial Sequence
  chemically synthesized
QVQLVQSGGGVVQPGRSLRLSCAASGFTFSSSAMHWVRQAPGKGLEWVAMIWHDESKKYYADSVKGRFTISRDNSKNTLYLQMNSLRAEDTAVYYCARPPDGGNSGRWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2399 - protein, 455 aa, Artificial Sequence
  chemically synthesized
QMQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDKNVRKHDYGDHPYGGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2400 - protein, 444 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVAGATSLWYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2401 - protein, 447 aa, Artificial Sequence
  chemically synthesized
QVQLQQSGPGLVKPSQSLSLTCAISGDSVSSNSAAWNWIRQSPSRGLEWLGRTYYRSKWYNDYAVSVKSRITIKPDTSKNQFSLQLNSVTPEDTAVYYCTRLANSDGVDVWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2402 - protein, 446 aa, Artificial Sequence
  chemically synthesized
QVQLQQSGPGLVKPSQTLSLTCAISGDSVSSDSAVWTWIRQSPSRGLEWLGRTYYKSKWYNDYAASVKSRITINPDTSKNQFSLHLNSVTPEDTAVYYCARGVTRTFDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2403 - protein, 445 aa, Artificial Sequence
  chemically synthesized
QLQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCAEGNGPFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2404 - protein, 446 aa, Artificial Sequence
  chemically synthesized
QITLKESGGGVVQPGRSLRLSCVASGFTFSTYPMHWVRQAPGKGLEWVAVISYDGRNEYYADSVKGRFTISRDNSKNTLYLQMNSLRAEDTAVYYCATRDTPLVGVSIYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2405 - protein, 447 aa, Artificial Sequence
  chemically synthesized
QMQLVQSGGGLVKAGGSLRLSCSASGFTFSSYAMHWVRQAPGKGLEYVSAISSNGGSTYYADSVKGRFTISRDNSKNTLYLQMSSLRAEDTAVYYCVNRAGYGDYRHFQHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2406 - protein, 445 aa, Artificial Sequence
  chemically synthesized
EVQLVQSGGGVVQPGGSLRLSCAASGFTFSSYGMHWVRQAPGKGLEWVAFISYDGSNKYYADSVKGRFTISRDNSKNTLYLQMNSLRAEDTAVYYCATTGDRFQEFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2407 - protein, 448 aa, Artificial Sequence
  chemically synthesized
QMQLVQSGGVLLQPGRSLRLSCTASGFTFAAYNINWFRQGPGGGLEWVGFIRANADSGTTEYAASVKGRFFISRDDSRSTAYLQMTSLKTEDTAVYYCARDDRGRGDDFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2408 - protein, 447 aa, Artificial Sequence
  chemically synthesized
QVQLVQSGGGLVQPGGSLRLSCAASGFTFSSYGMTWVRQAPGKGLEWVSTISGNGVGTYYPDSVKDRFTISRDSSKNTVYLQMNSLRAEDTAVYYCVKHGRAGINWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2409 - protein, 447 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGGGLWAFDIWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2410 - protein, 443 aa, Artificial Sequence
  chemically synthesized
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARDKIGSCPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2411 - protein, 447 aa, Artificial Sequence
  chemically synthesized
QVTLKESGPTLVKPTQTLTLTCTFSGFSLSTSGVGVGWIRQPPGKALEWLALIYWDDDKRYSPSLKSRLTITKDTSKNQVVLTMTNMDPVDTATYYCAHRPDSSSQCFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2412 - protein, 445 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARSSGWSLPEDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2413 - protein, 448 aa, Artificial Sequence
  chemically synthesized
QVQLVQSGAEVKKPGASVKVSCKVSGYTLTELSMHWVRQAPGKGLEWMGGFDPEDGETIYAQKFQGRVTMTEDTSTDTAYMELSSLRSEDTAVYYCATDVNPELLGAGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2414 - protein, 449 aa, Artificial Sequence
  chemically synthesized
QVTLKESGGGLVQPGGSLRLSCAASGFTFSDQYMDWVRQAPGKGLEWVGRVRNKANSYTTEYAASVKGRFTISRDDSKNSLYLQMNSLNTEDTAMYFCASSLNSGGYRCFHHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2415 - protein, 449 aa, Artificial Sequence
  chemically synthesized
QVQLVQSGGGLVQPGGSLRLSCSASGFTFSSYAMHWVRQAPGKGLEYVSAISSNGGSTYYADSVKGRFTISRDNSKNTLYLQMSSLRAEDTAVYYCVKAPRGVVPAAMRGGYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2416 - protein, 450 aa, Artificial Sequence
  chemically synthesized
QVQLQESGGGLVQPGRSLRLSCTASGFTFGDYAMSWFRQAPGKGLEWVGFIRSKAYGGTTEYAASVKGRFTISRDDSKSIAYLQMNSLKTEDTAVYYCTRLVGNSGSYYPFGYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2417 - protein, 455 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGRSLPYRGLAPRSFGGYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2418 - protein, 447 aa, Artificial Sequence
  chemically synthesized
QVQLQESGGGLVRPGGSLRLSCGDSGFNFSGYEMNWVRQAPGKGLEWVSYVSTSGSTRYYADSVKGRFTISRDNAKNTLYLQMNSLRVEDTAVYYCARGRTHWGPQDFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2419 - protein, 450 aa, Artificial Sequence
  chemically synthesized
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKGGMYYYGSGSSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2420 - protein, 447 aa, Artificial Sequence
  chemically synthesized
QVQLVQSGGGLVQPGGSLRLSCAASGFTFSSYAMSWVRQAPGKGLEWVSGISGSGGSTYYADSVKGRFTISRDNSKNMLFLQMNSPRAEDTAVYYCAKKIAAAGKQPVDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2421 - protein, 457 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARRKVYDYVWGSYRLPGSVSYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2422 - protein, 445 aa, Artificial Sequence
  chemically synthesized
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLPGRAARPDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2423 - protein, 451 aa, Artificial Sequence
  chemically synthesized
QVTLKESGGGVVQPGRSLRLSCAASGFTFSSYAMHWVRQAPGKGLEWVAVISYDGSNKYYADSVKGRFTISRDNSKNTLYLQMNSLRAEDTAVYYCARGPGAVAGTKPKYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2424 - protein, 449 aa, Artificial Sequence
  chemically synthesized
EVQLVQSGGGVVQPGRSLRLSCAASGFTFSSYAMHWVRQAPGKGLEWVAVISYDGSNKYYADSVKGRFTISRDNSKNTLYLQMNSLRAEDTAVYYCARATYYYDSSGYRFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2425 - protein, 442 aa, Artificial Sequence
  chemically synthesized
EVQLVQSGGGLVEPGGSLRLSCAASRFTFSDAWMSWVRQAPGKGLEWVGRIKSKISGGTTDYAAPVQGRFTISRDDSKNTLYLQMDSLKTEDTAVYYCANRNLGYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2426 - protein, 453 aa, Artificial Sequence
  chemically synthesized
EVQLVQSGAEVKKPGASVKVSCKASGYTFTSYAMHWVRQAPGQRLEWMGWINAGNGNTKYSQKFQGRVTMTTDTSTSTAYMELRSLRSDDTAVYYCARARYYDSSGYIAPSGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2427 - protein, 448 aa, Artificial Sequence
  chemically synthesized
QVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARDGPAVDGAEYFQHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2428 - protein, 449 aa, Artificial Sequence
  chemically synthesized
QLQLQESGPGLVKPSQTLSLTCAISGDSVSSNSAAWNWIRQSPSRGLEWLGRTYYRSKWYNDYAVSLKSRITINPDTSKNQFSLQLNSVTPEDTAVYYCASLASGSPPPGDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2429 - protein, 445 aa, Artificial Sequence
  chemically synthesized
QVTLKESGGGVVQPGRSLRLSCAASGFTFSTYGMHWVRQAPGKGLEWVALISYDGSKKYYANSVKGRFTISRDNSKNTLYLQMKSLRAEDTAMYYCAKGPIVGATMDYWGQGALVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2430 - protein, 444 aa, Artificial Sequence
  chemically synthesized
EVQLVQSGAEVKKPGSSVKVSCKASGGTFSSYAISWVRQAPGQGLEWMGWISAYNGNTNYAQKLQGRVTMTTDTSTSTAYMELRSLRSDDTAVYYCARWYGDYGLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2431 - protein, 454 aa, Artificial Sequence
  chemically synthesized
EVQLVQSGAEVKKPGASVKVSCKASGYTFTSYAMHWVRQAPGQRLAWMGWINAGNGNTKYSEKFEGRVTITRDTSASTAYMELSSLRSEDTAVYYCARVAKYYYESGGYRASNWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2432 - protein, 453 aa, Artificial Sequence
  chemically synthesized
QVQLQESGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARAPPPTVGWYAPVFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2433 - protein, 446 aa, Artificial Sequence
  chemically synthesized
QLQLQESGGGLVQPGGSLRLSCSASGISFRDYWMHWIRQTPGKGLVWVSRINPDGSSTSYADSVKGRFTISRDNSKNTLYLQMNSLRAEDTAVYYCAKVTGRRVGAHDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2434 - protein, 447 aa, Artificial Sequence
  chemically synthesized
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAFAQPGAETLNFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2435 - protein, 446 aa, Artificial Sequence
  chemically synthesized
QVQLQQSGPGLVKPSQTLSLTCAISGDSVSSKSAAWNWIRQSPSRGLEWLGRTYYRSKWNNDYALSVKSRITINPDTSKNQFSLQLKSVTPEDTALYYCVRQVAGGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2436 - protein, 449 aa, Artificial Sequence
  chemically synthesized
QVQLVQSGGGLVQPGRSLRLSCTASGFTFGDYAMSWFRQAPGKGLEWVSAISGSGGSTYYADSVKGRFTISRDNSKNTLYLQMNSLRAEDTAVYYCAKGSVYSGSYYMLIDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2437 - protein, 451 aa, Artificial Sequence
  chemically synthesized
QVQLQQSGPGLVRPSQTLSLTCVISGDSVSSGSAAWNWIRQSPSRGLEWLGRTYYRAKWYNEYAGSVKSRITISPDTSKNQFSLQLNSVTPEDTAVYFCTRQDKDNTRYSGLGVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2438 - protein, 449 aa, Artificial Sequence
  chemically synthesized
EVQLVETGGGLVQPGGSLRLSCAASEFTLRNYGVSWVRQAPGKGLEWVSGMSGSGYSTYYADSVKGRFTISRDSSKNTLFLQMDSLRAEDTAIYYCARGPRMWSSGIDAFDIWGHGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2439 - protein, 442 aa, Artificial Sequence
  chemically synthesized
QVQLQQWGAGLLKPSETLSLTCAVYGGSVSGYYWSWIRQPPGKGLEWMGEIHHSGSTNYNPSLKSRVTISLDTPKNQFSLKLSSVTAADTAVYYCARRDWAGKRVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2440 - protein, 448 aa, Artificial Sequence
  chemically synthesized
QVQLQQSGPGLLKPSQTLSLTCAISGDSVSSNTATWNWIRQSPSRGLEWLGRTYYRSKWYKDNALSVKSRITINPDTSKNQFSLQLNSVTPEDTAVYYCAGGRAGIAAFDIWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2441 - protein, 446 aa, Artificial Sequence
  chemically synthesized
QVQLVQSGGGLIQPGGSLRLSCAASGFTVSSNYMSWVRQAPGKGLEWVSLIYSDGRTNYADSVKGRFTISRDNSKNTLYLQMNSLRAEDTAVYYCAKGALQGEWRRFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2442 - protein, 452 aa, Artificial Sequence
  chemically synthesized
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCTRTNQGYGGNSGVFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2443 - protein, 446 aa, Artificial Sequence
  chemically synthesized
QVQLQQSGPGLVKPSQTLSLTCAISGDSVSGNSAAWNWIRQSPSRGLEWLGRTYYRSKWYNDYAVSVKSRITINPDTSKNQFSLQLNSVTPEDTAVYYCARIVGGAVDCWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2444 - protein, 450 aa, Artificial Sequence
  chemically synthesized
EVQLVQSGAEVKKPGASVKVSCKASGYTFTSYAMHWVRQAPGQRLEWMGWINAGNGNTKYSQKFQGRVTITRDTSASTAYMELSSLRSEDTAVYYCARVRVGATTVYDSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2445 - protein, 455 aa, Artificial Sequence
  chemically synthesized
QVQLVQSGGGLVQPGGSLRLSCAASGFTFSSYAMSWVRQAPGKGLEWVSAISGSGGSTYYADSVKGRFTISRDNSKNTLYLQMNSLRAEDTAVYYCAKDGGSSPYYDSSGLLPWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2446 - protein, 445 aa, Artificial Sequence
  chemically synthesized
QVQLQESGGGLVQPGGSLRLSCAASGFTFSSYAMHWVRQAPGKGLEYVSAISSNGGSTYYANSVKGRFTISRDNSKNTLYLQMGSLRAEDMAVYYCARAKFWTYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2447 - protein, 448 aa, Artificial Sequence
  chemically synthesized
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGGGSGSYYKRFFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2448 - protein, 453 aa, Artificial Sequence
  chemically synthesized
EVQLVQSGAEVRKPGASVKVSCKASGYTFTSYAISWVRQAPGQGLEWMGWISAYDGNTNYAQKLQGRVTMTTDTSTSTAYMEVRSLRSDDTAVYYCARDGTVRRVVGATTPGNFDYRGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2449 - protein, 450 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDLNRGYCSGGSCFGYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2450 - protein, 446 aa, Artificial Sequence
  chemically synthesized
QVQLQESGGGLVQPGGSLRLSCAASGFTFSSYAMSWVRQAPGKGLEWVSYISSSGTTIYYADSVKGRFTVSRDNAKNSLYLQMNSLRAEDTAVYYCARDYSSSGECFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2451 - protein, 446 aa, Artificial Sequence
  chemically synthesized
EVQLVQSGGGVVQPGRSLRLSCAASGFTFSSYGMHWVRQAPGKGLEWVAVIWYDGSNKYYADSVKGRFTISRDNSKNTLYLQMNSLRAEDTAVYYCARDQAAMVGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2452 - protein, 449 aa, Artificial Sequence
  chemically synthesized
QVTLKESGGGVVQPGRSLRLSCAASGFIFSNYAIHWVRQAPGKGLEWVAVISYDGSNKYYADSVKGRFTISRDNSKNTLYLQMNSLRAEDTAVYYCARTFAGYSSKLGYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 2453 - DNA, 1350 bp, Artificial Sequence
  chemically synthesized
gaagtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagaggctccttgtcccgaagtggctggtacgccggactctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2454 - DNA, 1350 bp, Artificial Sequence
  chemically synthesized
cagatcaccttgaaggagtctgggggaggcgtggtccagcctgggaggtccctgagactctcctgtgcagcctctggattcaccttcagtagttatagcatgaactgggtccgccaggctccaggcaaggggctgcagtgggtggcaattatatcagatgatggaagtaagagttactacgcagactccgtgcagggccgattcaccatctccagagacaattcgaggaacacagtatttctgcaaatgaacagcctgagagctgaggacacggctatgtattactgtgcgagagacaggggaactaaatggaaccaattgaatgatgtttttgatatgtggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2455 - DNA, 1347 bp, Artificial Sequence
  chemically synthesized
gaagtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagaggccgagggtatagcagcagtcggctctactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2456 - DNA, 1338 bp, Artificial Sequence
  chemically synthesized
caggtcaccttgaaggagtctgggggaggcttggtccggcctggagggtccctgagactctcctgtgaagcctctggattcaccttcagtgacccctacatggactgggtccgccaggctccaggcaaggggctggagtgggttggccgaattacaaataagcgtaccggttacgccacaacatatgccgcgtctgtgaaggacagattcaccatctcaagagatgattcaaggaagtcagtatatctgcaaatgaacagcctgaagaccgaggacacggccgtatattattgtgcaacagatgtcagtgggtccttcgcggcctacgggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2457 - DNA, 1335 bp, Artificial Sequence
  chemically synthesized
gaggtccagctggtacagtctgggggaggcgtggtccagcctgggaggtccctgagactctcctgtgcagcgtctggattcaccttcagtagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgggagagggcggagcagtggctggtactgtctactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2458 - DNA, 1326 bp, Artificial Sequence
  chemically synthesized
caggtccagctggtgcagtctgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagacgagtatttctactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2459 - DNA, 1347 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagtaaatccggggagttatacgagggaggtgagcaactttgactactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2460 - DNA, 1341 bp, Artificial Sequence
  chemically synthesized
caggtacagctgcagcagtcaggtccagaattggtgaagccctcgcagaccctcacactcacctgtggcatctccggggacagtgtctctagcaacagtgttacttggaactgggtcaggcagtccccatcgagaggccttgagtggctgggaaggacttactaccggtcccagtggtattataattatgcggtgtctgtgaaaagtcgaataaccatcagcccagacacatccaagaaccagttctccctgcagttgaattctgtgactcccgaggacacggctgtctattactgtgcaaccaggggacataactacggtgtagattactggggcccggggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2461 - DNA, 1338 bp, Artificial Sequence
  chemically synthesized
caggtgcagctggtgcagtctgggggaggcttggtaaagcctggggggtcccttagactctcctgtgcagcctctggattcactttcagtaacgcctggatgagctgggtccgccaggctccagggaaggggctggagtgggtttgccgtattaaaagcaaaactgatggtgagacaacagactacgctgcacccgtgaaaggcagattcaccatctcaagagatgattcaaaaaacacgctgtatctgcaaatgaacagcctgaaaactgaggacacagccgtgtatcactgtaccacaggggtgggatggtcgcccttccaatactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2462 - DNA, 1359 bp, Artificial Sequence
  chemically synthesized
gaggtccagctggtacagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagacgacaaaatagcagcagctggattcacatactggtacttcgatctctggggccgtggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2463 - DNA, 1332 bp, Artificial Sequence
  chemically synthesized
caggtgcagctggtgcagtctggggctgaggtgaagaagcctggggcctcagtgaaggtctcctgcaaggcttctggatacaccttcgccgcctattatttacactgggtgcgacaggcccctggacaaggccttgagtggatggggcggatcagccctggtaacggtgtcacaagttatgcacagaaatttcagggcagagtcaccatgaccggggacacgtccattaacacagtctacatgcaactgaacaatttgatttctggcgacacggccgtatattactgtgcgagagaggctgccgacgacccgtttgaccattggggccagggagccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2464 - DNA, 1323 bp, Artificial Sequence
  chemically synthesized
gaagtgcagctggtgcagtctgggggaggcgtggtccagcctgggaggtccctgacactctcctgtgcagcctctggattcaccttcagttcccatcttatgcactgggtccgccaggctccaggcaaggggctggagtgggtggcagttatatcatatgatggaactagtaaatattacggagactccgtgaagggccgcttcaccatctccagagacaattccaagaacacgttgtatctgcaaatgaacagcctgcgagctgaagacacggctatatattactgtgcgaaagcagattataaatatgactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2465 - DNA, 1353 bp, Artificial Sequence
  chemically synthesized
gaggtgcagctggtgcagtctgggggaggcttggtcaagcctggagggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactactcatagacgcccaatttacgatattttgactggttttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2466 - DNA, 1341 bp, Artificial Sequence
  chemically synthesized
cagctgcagctgcaggagtccgggggaggcttggtacagccagggcggtccctgagactctcctgtacagcttctggattcacctttggtgattatgctatgagctgggtccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagaggatactatggttcggggagttattccctggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2467 - DNA, 1362 bp, Artificial Sequence
  chemically synthesized
cagctgcagctgcaggagtccggctcaggactggtgaagccttcacagaccctgtccctcacctgcgctgtctctggtggctccatcagcagtggtggttactcctggagctggatccggcagccaccagggaagggcctggagtggattgggtacatctatcatagtgggagcacctactacaacccgtccctcaagagtcgagtcaccatatcagtagacaggtccaagaaccagttctccctgaagctgagctctgtgaccgccgcggacacggctgtgtattactgtgcgagagatcggcgttactatgatagtagtggttattatcccgcctactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2468 - DNA, 1344 bp, Artificial Sequence
  chemically synthesized
gaagtgcagctggtgcagtctgggggaggcctggtcaagcctggggggtccctgagactctcctgtgcagcctctggattcaccttcagtagctatagcatgaactgggtccgccaggctccagggaaggggctggagtgggtttcatacattagtagtagtggtagttacacaaactacgcagactctgtgaagggccgattcaccatctccagagacaacgccaagaactcactgtatctgcaaataaacagcctgagagccgaggacacggccatttattactgtgcgagagacgggggctatgatagtagtggttttcactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2469 - DNA, 1365 bp, Artificial Sequence
  chemically synthesized
caggtacagctgcagcagtcaggtccaggactggtgaagccctcgcagaccctctcactcacctgtgccatctccggggacagtgtctctaacaacagggctgcttggaactggatcaggcagtcgccatcgagaggccttgagtggctgggaaggacatactacaggtccaagtggtataatgaatatgcagtctctgtgaaaagtcgaataaccatcaacccagacacatccaagaaccagttctccctgcagctgaactctatgactcccgaggactcggctgtgtattactgtgcaattttgcctagtagtggttatctacaggaccaccactactacggtatggacgtctggggccaagggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2470 - DNA, 1344 bp, Artificial Sequence
  chemically synthesized
gaggtgcagctggtgcagtctggagctgaggtgaagaagcctggggcctcagtgaaggtctcctgcaaggcttctggttacacctttaccagctacggtatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgagcagcctgagatctgaggacacggccgtgtattactgtgcgagagccgcggtgggggatggatacagctatggtcggctcgattggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2471 - DNA, 1359 bp, Artificial Sequence
  chemically synthesized
gaggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccctcgtattactatgatagtagtggttactttacctggtacttcgatctctggggccgtggcaccctggtgaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2472 - DNA, 1344 bp, Artificial Sequence
  chemically synthesized
gaggtccagctggtacagtctggagctgaggtgaagaagcctggggcctcagtgaaggtctcctgcaaggcttctggttacacctttaccagctatggtatcagctgggtgcgacaggcccctggacaagggcttgagtggatgggatggatcatccctatctttggtatagcaaactacgcacagaagttccagggcagagtcacgattaccgcggacaaatccacgagcacagcctacatggagctgagcagcctgagatctgaggacacggccgtgtattactgtgcgagagaactatacaactatggttcaaaggactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2473 - DNA, 1347 bp, Artificial Sequence
  chemically synthesized
gaagtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgaggggcggtacttgggatacagctatggttacgggctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2474 - DNA, 1350 bp, Artificial Sequence
  chemically synthesized
gaagtgcagctggtgcagtctggagcagaggtgaaaaagcccggggagtctctgaagatctcctgtaagggttctggatacagctttaccagctactggatcgcctgggtgcgccagatgcccgggaaaggcctggagtggatgggggtcatctatcctggtgactctgataccagatacagcccgtccttccaaggccaggtcaccatctcagccgacaagtccatcaataccgcctacctgcagtggagcagcctgaaggcctcggacaccgccatgtattactgtgcgagaccccattacgatattttgactggttcccgggcgccctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2475 - DNA, 1338 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccgagtggaatccaaggatgggtactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2476 - DNA, 1347 bp, Artificial Sequence
  chemically synthesized
gaggtgcagctggtggagtctgggggaggcgtggtccagcctgggaggtccctgagactctcctgtgcagcctctggattcactttcactgatgcctggatgaactgggtccgccaggctccagggaaggggctggagtggattggccgtgttaaaaacaaagctgatggtgagacaacggactacgctgcacccgtcaaaggcagaatcaccatctcaagagatgatgcaaagaacactctgtatgtgcaaatgaacagcctgaaaaccgaggacacagccgtgtattattgtaccgctgacctgcgactttctacgtgggatgcttatgatttctggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2477 - DNA, 1329 bp, Artificial Sequence
  chemically synthesized
cagatcaccttgaaggagtctgggggaggcttggtccagcctggggggtccctaagactctcttgtacagtctcaggattcacctttagtaacaattggatgacctgggtccgccagactccagggaaggggctggagtgggtggccaacataaagcaagatggaactgagaaacactatgtggactctgtgaagggccgattcaccatctccagagacaacgccgagaactcactgtatctgcagatgaacagcctgagaggtgaggacacggccgtgtattattgtgcgagaaacagtcaacgttcgtttgactactggggccagggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2478 - DNA, 1341 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagatttaggggatccccggggtggtattttgaactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2479 - DNA, 1353 bp, Artificial Sequence
  chemically synthesized
gaggtgcagctggtggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcccggtcgagcccctggggggagttatcgttataccagggggcttttgatatctggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2480 - DNA, 1341 bp, Artificial Sequence
  chemically synthesized
cagatcaccttgaaggagtctgggggaggcttggtacagcctggcaggtccctgagactctcctgtgcagcctctggattcacctttgatgattatgccatgcactgggtccggcaagctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagataacgatttttggagtgggaaagtctttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2481 - DNA, 1341 bp, Artificial Sequence
  chemically synthesized
gaagtgcagctggtgcagtctgggggaggcttggtacagcctggggggtccctgagactctcctgtgcagcctctggattcaccttcagtagttatagcatgaactgggtccgccaggctccagggaaggggctggagtgggtttcatacatcagtagtactagtagtaccatatactacgcagactccgtgaagggccgattcaccatctccagagacaattccaagaatatgctgtttctacaaatgaacagcctgagagctgaggacacggctgtgtattactgtgcgaaagaagggggcagtggctggcgccactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2482 - DNA, 1347 bp, Artificial Sequence
  chemically synthesized
caggtcaccttgaaggagtctgggggaggcgtggtccagcctgggaggtccctgagactgtcctgtgcagcctctggattcaccttcagcagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagagattattgtagtagtaccagctgccagaactggttcgacccctggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2483 - DNA, 1335 bp, Artificial Sequence
  chemically synthesized
caggtccagctggtgcagtctgggggaggcttggtacagcctggggggtccctgagactctcctgtgcagcctctggattcacctttagcaactatgtcatgagctgggtccgccaggctccagggaaggggctggagtgggtctcagctattagtggtattggtgatactacatactacgcggactccgtgaagggccgattcaccatctccagagacaacgccaagaacacgctgtatctgcaaatgaacagtctgagagccgaggacacggctgtgtattactgtgcaagagggcgcgtggcgggggatgcttttgatatctggggccaagggacaatggtgaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2484 - DNA, 1347 bp, Artificial Sequence
  chemically synthesized
cagctgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcaaggggcagcagctggtaccctggggtactttgactactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2485 - DNA, 1347 bp, Artificial Sequence
  chemically synthesized
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacagtggtaacacaggctatgcacagaagttccagggcagagtcaccatgaccaggaacacctccataagcacagcctacatggagctgagcagcctgagatctgaggacacggccgtgtattactgtacgagaggaatctatgatagtagtggttcttccaatccctttgactcctggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2486 - DNA, 1350 bp, Artificial Sequence
  chemically synthesized
gaggtgcagctggtgcagtctggggctgaggtgaagaagcctggggcctcagtgaagatttcctgcgaggcttctggatacaccttcactgattatgctatacattgggtgcgccaggcccccggacaaagacttgagtggatgggatggatcaacgctggcgatggtggcacaaaaagttcacgggagttccagggcagagtcaccattaccagggacacatccgcgaccacagcctacatggaggtgagcagtctgagatctgaagacacggctgtctattactgtgcgagaggatattgtagtggtggtagctgcccaggaacggattttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2487 - DNA, 1344 bp, Artificial Sequence
  chemically synthesized
caggtgcagctggtgcagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagagatggtgtaggagggagagatggctacaattttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2488 - DNA, 1335 bp, Artificial Sequence
  chemically synthesized
gaagtgcagctggtgcagtctgggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggccgattcaccatctccagagacaattccaagaacacgctgtatcttcaaatgaacagcctgagagctgaggacacggctgtgtattactgtgcgagagcccccctagcagcagatggctactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2489 - DNA, 1344 bp, Artificial Sequence
  chemically synthesized
gaggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagcccgggggctacagtacctaatctggtacttcgatctctggggccgtggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2490 - DNA, 1347 bp, Artificial Sequence
  chemically synthesized
caggtccagctggtacagtctggggctgaggtgaagaagcctggggcctcagtgaaggtttcctgcaaggcatctggatacaccttcaccagctactatatgcactgggtgcgacaggcccctggacaagggcttgagtggatgggaataatcaaccctagtggtggtagcacaagctacgcacagaagttccagggcagagtcaccatgaccagggacacgtccacgagcacagtctacatggagctgagcagcctgagatctgaggacacggccgtgtattactgtgcgagcccgggtatggttcggggagttattactgccccgcttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2491 - DNA, 1338 bp, Artificial Sequence
  chemically synthesized
gaggtccagctggtacagtctgggggaggcctggtcaagcctggggggtccctgagactctcctgtgcagcctctggattcaccttcagcagctatgctatcagctgggtgcgacaggcccctggacaagggcttgagtggatgggagggatcatccctatgtatggtacagcaaactacgcacagaagttccagggcagagtcacgattaccgcggacgaatccacgagcacagcctacatggaactgagcagcctgagatctgaggacacggccctctattactgtgcgagagaagctaagtggggaatgtactactttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2492 - DNA, 1350 bp, Artificial Sequence
  chemically synthesized
gaggtgcagctggtggagtccgggggaggcgtggtccagcctgggaggtccctgagactctcctgtgcagcctctggattcaccttcagtagctatgctatacactgggtccgccaggctccaggcaaggggctggagtgggtggcaattatatcagatgatggaagtaagagttactacgcagactccgtgcagggccgattcaccatctccagagacaattcgaggaacacagtatatctgcaaatgaacagcctgagagctgaggacacggctatgtattactgtgcgagagacaggggaactaaatggaaccaattgaatgatgtttttgatatgtggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2493 - DNA, 1332 bp, Artificial Sequence
  chemically synthesized
cagatgcagctggtgcaatctggggctgaggtgaagaagcctggggcctcagtgaaggtctcctgcacggcttctggatacaccttcaccagttctgatatcaactgggtgcgacaggccactggacaagggcttgagtggatgggatggatgaaccctaacagtggtaacaccggctatgcagagaagttccagggcagggtcaccatgaccagcgactcctccataagcaccgcctacatggagttgagaagcctgaccactgaggacacggccgtatattactgtgcgagaggtgggggtgcgagctatactgactcctggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2494 - DNA, 1356 bp, Artificial Sequence
  chemically synthesized
caggtccagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtaccgctaaggggggctacgtcggatacagctatggaccttttgggggctactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2495 - DNA, 1347 bp, Artificial Sequence
  chemically synthesized
caggtgcagctggtgcagtctgggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagaggggggactatggttcggggtttcggatttaactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2496 - DNA, 1356 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagagcccggcgggctatgatagggccgcttccgcgacttgtcgggtacttcgatctctggggccgtggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2497 - DNA, 1350 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccgccccgccccatcctgggttaaaacccgtaactggttcgacccctggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2498 - DNA, 1335 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagaggctagcagtggctggaactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2499 - DNA, 1350 bp, Artificial Sequence
  chemically synthesized
caggtgcagctgcaggagtccggtccaggactggtgaagccctcgcagaccctctcactcacctgtgccatctccggggacagtgtctctagcaacaatgctgcttggaactggatcaggcagtccccatcgagaggccttgagtggctgggaaggacattctacaggtccaagtggtataatgactatgcagtttctgtgaaaagtcgactaaccgtcaacccagacacatccaagaaccagttctccctgcggttgaactctgtgagtcccgaggacacggctgtgtattactgtgcaagagggggaagatataccaagggagggtactttgacgactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2500 - DNA, 1347 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagattggatagcagtggccgtggtggttactttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2501 - DNA, 1359 bp, Artificial Sequence
  chemically synthesized
gaggtgcagctggtggagtctgggggaggcgtggtccagcctgggaggtccctgagactctcctgtacagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaagagttggtgggtaccagctctccttattactactactactacggtatggacgtctggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2502 - DNA, 1332 bp, Artificial Sequence
  chemically synthesized
cagctgcagctgcaggagtcggggggaggcttggtccagcctggggggtccctgagactctcctgtgcagcctctggattcaccgtcagtagcaactacatgagctgggtccgccaggctccagggaaggggctggagtgggtctcagttatttatagcggtggtagcacatactacgcagactccgtgaagggcagattcaccatctccagagacaattccaagaacacgctgtatcttcaaatgaacagcctgagagccgaggacacggctgtgtattactgtgcgagagactattactatggttcggggagttctccctggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2503 - DNA, 1353 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggccggccatattgtagtagtaccagctgctacccagagtggttcgacccctggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2504 - DNA, 1359 bp, Artificial Sequence
  chemically synthesized
caggtcaccttgaaggagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaattaaggggtatagattactatgatagtagtggttaccaacgggggtttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2505 - DNA, 1335 bp, Artificial Sequence
  chemically synthesized
caggtgcagctgcaggagtccggcccaggactggtgaagccttcggagaccctgtccctcacctgcactgtctctggtggctccatcagtagttactactggagctggatccggcagcccccagggaagggactggagtggattggctatatctattacactgggagcaccaactacaacccctccctcaagagccgagtcaccatatcagtagacacgtccaagaaccagttctccctgaagctgagctctgtgaccactgcggacacggccgtgtattactgtgcgagaggtgggaggggggatggggccgcttttgacatctggggccaagggacaatggtcaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2506 - DNA, 1347 bp, Artificial Sequence
  chemically synthesized
caggtgcagctggtgcaatctgggggaggcgtggtccagcctgggaggtccctgagactctcctgtgcagcgtctggattcaccttcagcagctctgccatgcactgggtccgccaggctccaggcaagggactggagtgggtggcaatgatttggcatgatgagagtaagaaatactatgcagactccgtgaagggccgattcactatctccagagacaattccaagaacacgctgtatctgcaaatgaacagcctgagagctgaggacacggctgtgtattactgtgcgagaccccccgacggtggtaactccggtcgctggtacttcgatctctggggccgtggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2507 - DNA, 1365 bp, Artificial Sequence
  chemically synthesized
cagatgcagctggtgcaatctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagacaagaacgtccgaaaacatgactacggtgaccacccctacggggggtactttgactactggggccagggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2508 - DNA, 1332 bp, Artificial Sequence
  chemically synthesized
gaggtccagctggtacagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagtggcgggagctacttccctatggtactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2509 - DNA, 1341 bp, Artificial Sequence
  chemically synthesized
caggtacagctgcagcagtcaggtccaggactggtgaagccctcgcagagcctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaagagtcgaataaccatcaaaccagacacatccaagaaccagttctccctgcagctgaactctgtgactcccgaggacacggctgtgtattactgtacaaggctagctaattccgacggtgtggacgtctggggccaagggacaatggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2510 - DNA, 1338 bp, Artificial Sequence
  chemically synthesized
caggtacagctgcagcagtcaggtccaggactggtgaagccctcgcagaccctctcactcacctgtgccatctccggggacagtgtctctagcgacagtgctgtttggacctggatcaggcagtccccatcgagaggccttgagtggctgggaaggacatactacaagtcgaagtggtataatgattatgcagcatctgtgaaaagtcgaataaccatcaacccagacacatccaagaaccagttctccctgcacctgaactctgtgactcccgaggacacggctgtgtattactgtgcaagaggtgtaacccggacctttgactactggggccaggggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2511 - DNA, 1335 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcagaaggcaatgggccgttcgacccctggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2512 - DNA, 1338 bp, Artificial Sequence
  chemically synthesized
cagatcaccttgaaggagtctgggggaggcgtggtccagcctgggaggtccctgagactctcctgtgtagcctctggattcaccttcagtacctatcccatgcactgggtccgccaggctccaggcaaggggctggagtgggtggcagttatatcatatgatggacgtaatgaatactacgcagactccgtgaagggccgattcaccatctccagagacaattccaaaaacacgctgtatctgcaaatgaacagtctgcgagctgaagacacggctgtctattattgtgcgactcgggatacacctttggttggggtttcgatatactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2513 - DNA, 1341 bp, Artificial Sequence
  chemically synthesized
cagatgcagctggtgcaatctgggggaggcctggtcaaggctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaatcgggcgggttacggtgactacagacacttccagcactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2514 - DNA, 1335 bp, Artificial Sequence
  chemically synthesized
gaggtgcagctggtgcagtctgggggaggcgtggtccagcctggggggtccctgagactctcctgtgcagcgtctggattcaccttcagtagctatggcatgcactgggtccgccaggctccaggcaaggggctggagtgggtggcatttatatcatatgatggaagtaataaatactacgcagactccgtgaagggccgattcaccatctccagagacaattccaagaacacgctgtatctgcaaatgaacagcctgagagccgaggacacggccgtatattactgtgcgacaacaggggaccgcttccaagagtttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2515 - DNA, 1344 bp, Artificial Sequence
  chemically synthesized
cagatgcagctggtgcagtctgggggagtcttgcttcagccagggcggtccctgagactctcctgtacagcttctggattcacctttgctgcttataatatcaactggttccgccagggtcctgggggggggctggagtgggtaggtttcattagagccaacgctgatagtgggacaacagagtacgccgcgtctgtgaaaggcagattcttcatctcaagagatgattccagaagcaccgcctacctgcaaatgactagccttaaaaccgaggacacagccgtttattactgtgccagagatgatcggggtcggggagatgactttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2516 - DNA, 1341 bp, Artificial Sequence
  chemically synthesized
caggtgcagctggtgcaatctgggggaggcttggtacagcctggggggtccctgagactctcctgtgcagcctctggattcacctttagcagctatggcatgacgtgggtccgccaggctccagggaaggggctggagtgggtctcaactattagtggtaatggtgttggcacatactacccagactccgtgaaggaccggttcaccatctccagagacagttccaagaacacggtgtatctgcaaatgaacagcctgagagccgaggacacggccgtatattactgtgtgaaacatggtagggccggaataaactggtacttcgatctctggggccgtggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2517 - DNA, 1341 bp, Artificial Sequence
  chemically synthesized
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagggggagggctttgggcttttgatatctggggccaagggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2518 - DNA, 1329 bp, Artificial Sequence
  chemically synthesized
gaggtccagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacaagatcggcagctgtccttactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2519 - DNA, 1341 bp, Artificial Sequence
  chemically synthesized
caggtcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattgggatgatgataagcgctacagcccatctctgaagagcaggctcaccatcaccaaggacacctccaaaaaccaggtggtccttacaatgaccaacatggaccctgtggacacagccacatattactgtgcacacagaccggatagcagcagtcaatgttttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2520 - DNA, 1335 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaagcagtggctggtcactgcctgaagactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2521 - DNA, 1344 bp, Artificial Sequence
  chemically synthesized
caggtccagctggtacagtctggggctgaggtgaagaagcctggggcctcagtgaaggtctcctgcaaggtttccggatacaccctcactgaattatccatgcactgggtgcgacaggctcctggaaaagggcttgagtggatgggaggttttgatcctgaagatggtgaaacaatctacgcacagaagttccagggcagagtcaccatgaccgaggacacatctacagacacagcctacatggagctgagcagcctgagatctgaggacacggccgtgtattactgtgcaacggatgtgaacccggagctactgggggcgggatttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2522 - DNA, 1347 bp, Artificial Sequence
  chemically synthesized
caggtcaccttgaaggagtctgggggaggcttggtccagcctggagggtccctgagactctcctgtgcagcctctggattcaccttcagtgaccagtacatggactgggtccgccaggctccagggaaggggctggagtgggttggccgtgttagaaacaaagctaacagttacaccacagaatacgccgcgtctgtgaaaggcagattcaccatctcaagagatgattcaaagaactcactgtatctgcaaatgaatagtctgaacaccgaggacacggccatgtatttctgtgctagtagtctcaatagtgggggctaccgatgcttccatcactggggccagggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2523 - DNA, 1347 bp, Artificial Sequence
  chemically synthesized
caggtccagctggtgcagtctgggggaggcttggtccagcctggggggtccctgagactctcctgttcagcctctggattcaccttcagtagctatgctatgcactgggtccgccaggctccagggaagggactggaatatgtttcagctattagtagtaatgggggtagcacatactacgcagactcagtgaagggcagattcaccatctccagagacaattccaagaacacgctgtatcttcaaatgagcagtctgagagctgaggacacggctgtgtattactgtgtgaaagcgccgaggggtgtagtaccagctgctatgcgggggggctactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2524 - DNA, 1350 bp, Artificial Sequence
  chemically synthesized
caggtgcagctgcaggagtcggggggaggcttggtacagccagggcggtccctgagactctcctgtacagcttctggattcacctttggtgattatgctatgagctggttccgccaggctccagggaaggggctggagtgggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagattggtgggcaatagtgggagctactatccgtttgggtactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2525 - DNA, 1365 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctcggtgaccgccgcggacacggctgtgtattactgtgcgagaggccggtcccttccctaccgggggttggctcctagatctttcggaggatactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2526 - DNA, 1341 bp, Artificial Sequence
  chemically synthesized
caggtgcagctgcaggagtcggggggaggcttggtacggcctggagggtccctgagactctcctgtggagactctggattcaacttcagtggatatgaaatgaactgggtccgccaggctccagggaaggggctggagtgggtttcatacgtcagtactagtggtagtaccagatactacgcagactctgtgaagggccgatttaccatctccagagacaacgccaagaacaccctgtatttgcaaatgaacagtctgagagtcgaggacacggctgtgtattactgtgcaagaggacggactcactggggcccccaggactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2527 - DNA, 1350 bp, Artificial Sequence
  chemically synthesized
caggtgcagctgcaggagtcggggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaaggaggaatgtattactatggttcggggagctcgtactttgactactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2528 - DNA, 1341 bp, Artificial Sequence
  chemically synthesized
caggtgcagctggtgcaatctgggggaggcttggtacagcctggggggtccctgagactctcctgtgcagcctctggattcacctttagcagctatgccatgagctgggtccgccaggctccagggaaggggctggaatgggtctcaggtattagtggtagtggtggtagcacatactacgcagactccgtgaagggccggttcaccatctccagagacaattccaagaacatgctgtttctgcaaatgaacagcccgagagccgaggacacggccgtatattactgtgcgaagaaaatagcagcagctggtaagcaacctgttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2529 - DNA, 1371 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaaggaaggtgtatgattacgtttgggggagttatcgcctccccgggtcggtatcgtactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2530 - DNA, 1335 bp, Artificial Sequence
  chemically synthesized
caggtccagctggtacagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagactcccggggagagcagctcgtccagactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2531 - DNA, 1353 bp, Artificial Sequence
  chemically synthesized
caggtcaccttgaaggagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagaggccccggggcagtggctggtactaagccaaagtactactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2532 - DNA, 1347 bp, Artificial Sequence
  chemically synthesized
gaggtccagctggtgcagtctgggggaggcgtggtccagcctgggaggtccctgagactctcctgtgcagcctctggattcaccttcagtagctatgctatgcactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgagggccacgtattactatgatagtagtggttataggtttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2533 - DNA, 1326 bp, Artificial Sequence
  chemically synthesized
gaggtccagctggtacagtctgggggaggcttggtagaaccgggggggtcccttagactctcctgtgcagcctctcgattcactttcagtgacgcctggatgagctgggtccgccaggctccaggtaaggggctggagtgggttggccgtattaaaagcaaaataagtggtgggacaacagactacgctgcacccgtgcaaggcagattcaccatctcaagagatgattcaaaaaacacgctgtatctgcaaatggacagcctgaaaaccgaggacacagccgtgtattactgtgcgaaccgaaacttaggctactggggccagggcaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2534 - DNA, 1359 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccatgaccacagacacatccacgagcacagcctacatggagctgaggagcctgagatctgacgacacggccgtgtattactgtgcgagagctcgttactatgatagtagtggttatattgccccatcgggttactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2535 - DNA, 1344 bp, Artificial Sequence
  chemically synthesized
caggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagatggccccgccgttgatggtgctgaatacttccagcactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2536 - DNA, 1347 bp, Artificial Sequence
  chemically synthesized
cagctgcagctgcaggagtcgggtccaggactggtgaagccctcgcagaccctctcactcacctgtgccatctccggggacagtgtctctagcaacagtgctgcttggaactggatcaggcagtccccatcgcgaggccttgagtggctgggaaggacttactacaggtccaagtggtataatgattatgcagtatctctgaaaagtcgaataaccatcaacccggacacatccaagaaccagttctccctgcagctgaactctgtgactcccgaggacacggctgtatattactgtgcaagtttggcgagtggttccccccctccgggggactactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2537 - DNA, 1335 bp, Artificial Sequence
  chemically synthesized
caggtcaccttgaaggagtctgggggaggcgtggtccagcctgggaggtccctgagactctcctgtgcagcctctggattcaccttcagtacctatggcatgcactgggtccgccaggctccaggcaaggggctggagtgggtggcacttatatcatatgatggaagtaaaaaatactatgcaaactccgtgaagggccgattcaccatctccagagacaattccaagaacacgttgtatctgcaaatgaaaagtctgagagctgaggacacggctatgtattactgtgcgaaaggccctatagtgggagcgactatggactactggggccagggagccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2538 - DNA, 1332 bp, Artificial Sequence
  chemically synthesized
gaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggatggatcagcgcttacaatggtaacacaaactatgcacagaagctccagggcagagtcaccatgaccacagacacatccacgagcacagcctacatggagctgaggagcctgagatctgacgacacggccgtgtattactgtgcgagatggtacggtgactacggccttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2539 - DNA, 1362 bp, Artificial Sequence
  chemically synthesized
gaggtccagctggtgcagtctggggctgaggtgaagaagcctggggcctcagtgaaggtttcctgcaaggcttctggatacaccttcactagctatgctatgcattgggtgcgccaggcccccggacaaaggcttgcgtggatgggatggatcaacgctggcaatggtaacacaaaatattcagagaagttcgaaggcagagtcaccatcaccagggacacatccgcgagcacagcctacatggagctgagcagcctgagatctgaagacacggctgtgtattactgtgcgagggtcgccaaatattattacgagagtggtggttatcgggcctccaactggttcgacccctggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2540 - DNA, 1359 bp, Artificial Sequence
  chemically synthesized
caggtgcagctgcaggagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagcgccccctccgactgttggctggtacgcccccgtctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2541 - DNA, 1338 bp, Artificial Sequence
  chemically synthesized
cagctgcagctgcaggagtccgggggaggcttagttcagccgggggggtccctgagactctcctgctcagcctctggaatcagcttcagagattactggatgcactggatccgccaaactccagggaaggggctggtgtgggtctcacgtattaatcctgatgggagtagcacaagctacgcggactccgtgaagggccgattcaccatctccagagacaattccaagaacacgctgtatctgcaaatgaacagcctgagagctgaggacacggctgtgtattactgtgcgaaagttacgggacggagagtgggagcccatgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2542 - DNA, 1341 bp, Artificial Sequence
  chemically synthesized
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcctttgcccagccgggcgctgagacgttgaacttcgatctctggggccgtggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2543 - DNA, 1338 bp, Artificial Sequence
  chemically synthesized
caggtacagctgcagcagtcaggtccaggactggtgaagccctcgcagaccctctcactcacctgtgccatctccggggacagtgtctctagcaaaagtgctgcttggaactggatcaggcagtccccatcgagaggccttgagtggctgggaaggacatactacaggtccaaatggaataatgattatgcattatctgtgaaaagtcgaataaccatcaacccagacacatccaagaaccagttctccctgcagctgaagtctgtgactcccgaggacacggctctgtattactgtgtaagacaagtcgcgggcggtatggacgtctggggccaagggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2544 - DNA, 1347 bp, Artificial Sequence
  chemically synthesized
caggtgcagctggtgcaatctgggggaggcttggtacagccagggcggtccctgagactctcctgtacagcttctggattcacctttggtgattatgctatgagctggttccgccaggctccagggaaggggctggagtgggtctcagctattagtggtagtggtggtagcacatactatgcagactccgtgaagggccgattcaccatctccagagacaattccaagaacacgctgtatctgcaaatgaacagcctgagagctgaggacacggctgtgtattactgtgcgaaaggatcggtatatagtgggagctactatatgctcattgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2545 - DNA, 1353 bp, Artificial Sequence
  chemically synthesized
caggtacagctgcagcagtcaggtccaggactggtgaggccctcgcagaccctctcactcacctgtgtcatctccggggacagtgtctctagcggcagtgctgcttggaactggatcaggcagtccccatcgagaggccttgagtggctgggaaggacatattatagggccaagtggtataatgaatatgcagggtctgtgaaaagccgaataaccatcagtccggacacatccaagaaccagttctccctgcaactgaactctgtgactcccgaggacacggctgtgtatttctgtacaagacaagacaaagacaacacgagatattccggtttgggcgtctggggccaagggaccacggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2546 - DNA, 1347 bp, Artificial Sequence
  chemically synthesized
gaggtgcagctggtggagaccgggggaggcttagttcagcctggggggtccctgagactctcctgtgcagcctctgaattcacccttaggaactatggcgtgagctgggtccgccaggctccagggaaggggctggagtgggtctcaggtatgagtggtagtggttatagtacatactacgcagactccgtgaagggccggttcaccatctccagagacagttccaagaacacgctgtttctgcaaatggacagcctgagagccgaggacacggccatatattactgtgcgagagggccccgaatgtggagcagtggcattgatgcttttgatatctggggccacgggacaatggtgaccgtctcttcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2547 - DNA, 1326 bp, Artificial Sequence
  chemically synthesized
caggtgcagctacagcagtggggcgcaggactgttgaagccttcggagaccctgtccctcacctgcgctgtctatggtgggtccgtcagtggttactactggagctggatccgccagcccccagggaaggggctggagtggatgggggaaatccatcatagtggaagcaccaactacaacccgtccctcaagagtcgagtcaccatatcactagacacgcccaagaaccagttctccctgaagctaagctctgtgaccgccgcggacacggctgtatattactgtgcgagacgggattgggcaggaaaaagggtctggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2548 - DNA, 1344 bp, Artificial Sequence
  chemically synthesized
caggtacagctgcagcagtcaggtccaggactattaaagccctcgcagaccctctcactcacctgtgccatctccggggacagtgtctctagcaacactgctacttggaactggatcaggcagtccccatcgagaggccttgagtggctgggaaggacatactacaggtccaagtggtataaggataatgcactgtctgtgaaaagtcgaataaccatcaacccagacacatccaagaaccagttctccctgcagctgaactctgtgactcccgaggacacggctgtgtattactgtgcaggaggtcgggctggtattgccgcttttgatatctggggccaagggaccacggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2549 - DNA, 1338 bp, Artificial Sequence
  chemically synthesized
caggtgcagctggtgcaatctggaggaggcttgatccagcctggggggtccctgagactctcctgtgcagcctctgggttcaccgtcagtagcaactacatgagctgggtccgccaggctccagggaaggggctggaatgggtctcacttatttatagtgatggtcgcacaaactatgcagactccgtgaagggccgattcaccatctccagagacaattccaagaacacgctgtatctgcaaatgaacagcctgagagccgaggacacggccgtatattactgtgcgaagggggccctacagggcgaatggcggagatttgactactggggccagggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2550 - DNA, 1356 bp, Artificial Sequence
  chemically synthesized
caggtgcagctacagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacatattacaggtccaagtggtataatgattatgcagtatctgtgaaaagtcgaataaccatcaacccagacacatccaagaaccagttctccctgcagctgaactctgtgactcccgaggacacggctgtgtattactgtacaagaaccaaccagggatacggtggtaactccggggtatttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2551 - DNA, 1338 bp, Artificial Sequence
  chemically synthesized
caggtgcagctacagcagtcaggtccaggactggtgaagccctcgcagaccctctcactcacctgtgccatctccggggacagtgtctctggcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagttgaattctgtgactcccgaggacacggctgtgtattactgtgcgaggatagtgggaggtgccgttgactgctggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2552 - DNA, 1350 bp, Artificial Sequence
  chemically synthesized
gaggtgcagctggtgcagtctggggctgaggtgaagaagcctggggcctcagtgaaggtttcctgcaaggcttctggatacaccttcactagctatgctatgcattgggtgcgccaggcccccggacaaaggcttgagtggatgggatggatcaacgctggcaatggtaacacaaaatattcacagaagttccagggcagagtcaccattaccagggacacatccgcgagcacagcctacatggagctgagcagcctgagatctgaagacacggctgtgtattactgtgcgagagttagagtgggagctactactgtttacgacagctggttcgacccctggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2553 - DNA, 1365 bp, Artificial Sequence
  chemically synthesized
caggtgcagctggtgcagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatggggggtccagcccatactatgatagtagtggtttactaccctggtacttcgatctctggggccgtggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2554 - DNA, 1335 bp, Artificial Sequence
  chemically synthesized
caggtgcagctgcaggagtcggggggaggcttggtccagcctggggggtccctgagactctcctgtgcagcctctggattcaccttcagtagctatgctatgcactgggtccgccaggctccagggaagggactggaatatgtttcagctattagtagtaatgggggtagcacatattatgcaaactctgtgaagggcagattcaccatctccagagacaattccaagaacacgctgtatcttcaaatgggcagcctgagagctgaggacatggctgtgtattactgtgcgagagctaagttttggacatactactttgactactggggccagggaaccctggtgaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2555 - DNA, 1344 bp, Artificial Sequence
  chemically synthesized
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagaggcggtggttcggggagttattataagaggttctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2556 - DNA, 1359 bp, Artificial Sequence
  chemically synthesized
gaggtgcagctggtgcagtctggagctgaggtgaggaagcctggggcctcagtgaaggtctcctgcaaggcttctggttacacatttaccagttatgccatcagctgggtgcgacaggcccctggacaagggcttgagtggatggggtggatcagcgcttacgacggtaacacaaactatgcacagaagctccagggcagagtcaccatgaccacagacacatccacgagcacagcctacatggaggtgaggagcctgagatctgacgacacggccgtgtattactgtgcgagagatggtacggtccgaagggtagtgggagctactacccctggaaactttgactacaggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2557 - DNA, 1350 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatctgaatcgaggatattgtagtggtggtagctgctttggctactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2558 - DNA, 1338 bp, Artificial Sequence
  chemically synthesized
caggtgcagctgcaggagtctgggggaggcttggtacagccgggggggtccctgagactctcctgtgcagcctctggattcacctttagcagctatgccatgagctgggtccgccaggctccagggaaggggctggagtgggtttcatacattagtagtagtggtactaccatatactacgcagactctgtgaagggccgattcaccgtctccagagacaatgccaagaactcactgtatctgcaaatgaacagcctgagagccgaggacacggccgtgtattactgtgcgagggattatagcagctcgggggagtgctttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2559 - DNA, 1338 bp, Artificial Sequence
  chemically synthesized
gaggtgcagctggtgcagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggacacggctgtgtattactgtgcgagagatcaggcagctatggtaggctactttgactactggggccagggaaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2560 - DNA, 1347 bp, Artificial Sequence
  chemically synthesized
caggtcaccttgaaggagtctgggggaggcgtggtccagcctgggaggtccctgagactctcctgtgcagcctctggattcatcttcagtaactatgctatacactgggtccgccaggctccaggcaaggggctggagtgggtggcagttatatcatatgatggaagtaataaatactacgcagactccgtgaagggccgattcaccatctccagagacaattccaagaacacgctgtatctgcaaatgaacagcctgagagctgaggacacggctgtgtattactgtgcgaggacttttgcggggtatagcagcaaactggggtacttcgatctctggggccgtggcaccctggtcaccgtctcctcagcaagcacaaaaggtccttcagtgttccctctggcaccttgctcacgcagcacctctgagagtacagccgccctgggctgcctggtaaaggactactttcccgaaccagtcactgtgtcctggaatagcggggccttgacctctggagtgcacacatttccagctgtactgcagtcatctggactctacagcctgtccagtgtggtcaccgtaccttcctccaactttggcactcaaacatatacatgtaacgtggatcataagccctctaacaccaaagtggataaaactgtggagcgtaagtgttgtgtcgagtgtcctccttgtcctgctcctcctgtggcaggcccatctgtgtttctctttcccccaaagccaaaggacactttgatgatatcccggacccctgaggtgacttgcgtcgtcgtagatgtttcacacgaagatccagaggtgcagttcaactggtacgtggatggcgtggaagtgcataatgccaagacaaagccccgcgaagagcagtttaattccaccttccgcgtggtgtctgtgctgaccgtggtacatcaggattggcttaacggtaaggagtacaagtgcaaggtgagtaacaaggggctgcccgcccctatcgagaagactatcagtaaaaccaagggccagccaagggagccacaggtgtacacacttccaccatctagggaggaaatgacaaagaaccaggtgagtttgacctgtctcgtgaaaggcttttatcccagtgatatagccgtggaatgggaaagtaacgggcagcccgagaacaactataagaccacaccacccatgctggactccgacggttctttcttcctttatagcaagctgacagtggataaatccaggtggcagcagggtaacgtattcagttgcagtgtcatgcacgaggcactccacaaccactatactcagaaaagtctttccctgagtccaggcaag

SEQ ID NO: 2561 - protein, 5 aa, Artificial Sequence
  amino acid sequence recognized by anti-CLEC2D antibody
  misc_feature (2)..(2): Xaa can be any naturally occurring amino acid
EXTRQ

SEQ ID NO: 2562 - protein, 5 aa, Artificial Sequence
  amino acid sequence recognized by anti-CLEC2D antibody
  misc_feature (2)..(2): Xaa can be any naturally occurring amino acid
  misc_feature (4)..(4): Xaa can be any naturally occurring amino acid
RXYXE

SEQ ID NO: 2563 - protein, 7 aa, Artificial Sequence
  amino acid sequence recognized by anti-CLEC2D antibody
  misc_feature (2)..(4): Xaa can be any naturally occurring amino acid
  misc_feature (6)..(6): Xaa can be any naturally occurring amino acid
RXXXSXD

SEQ ID NO: 2564 - protein, 7 aa, Artificial Sequence
  amino acid sequence recognized by anti-CLEC2D antibody
  misc_feature (2)..(3): Xaa can be any naturally occurring amino acid
  misc_feature (5)..(6): Xaa can be any naturally occurring amino acid
EXXQXXK

SEQ ID NO: 2565 - protein, 4 aa, Artificial Sequence
  amino acid sequence recognized by anti-CLEC2D antibody
  misc_feature (3)..(3): Xaa can be any naturally occurring amino acid
EQXQ

SEQ ID NO: 2566 - protein, 6 aa, Artificial Sequence
  amino acid sequence recognized by anti-CLEC2D antibody
  misc_feature (2)..(2): Xaa can be any naturally occurring amino acid
  misc_feature (4)..(5): Xaa can be any naturally occurring amino acid
RXYXXR

SEQ ID NO: 2567 - protein, 4 aa, Artificial Sequence
  amino acid sequence recognized by anti-CLEC2D antibody
  misc_feature (2)..(3): Xaa can be any naturally occurring amino acid
YXXK
